United States Patent
Sehgal et al.

(10) Patent No.: US 11,266,655 B2
(45) Date of Patent: *Mar. 8, 2022

(54) METHODS AND COMPOSITIONS FOR TREATING UREA CYCLE DISORDERS

(71) Applicant: Camp4 Therapeutics Corporation, Cambridge, MA (US)

(72) Inventors: Alfica Sehgal, Cambridge, MA (US); Alla A. Sigova, Newton, MA (US); Igor Zlobine, Cambridge, MA (US); Brian E. Schwartz, Somerville, MA (US); David A. Bumcrot, Belmont, MA (US); Vaishnavi Rajagopal, Andover, MA (US); Yun Joon Jung, Lexington, MA (US); Yuichi Nishi, Ayer, MA (US)

(73) Assignee: CAMP4 THERAPEUTICS CORPORATION, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/121,639

(22) Filed: Dec. 14, 2020

(65) Prior Publication Data

US 2021/0114996 A1 Apr. 22, 2021

Related U.S. Application Data

(63) Continuation of application No. PCT/US2020/027693, filed on Apr. 10, 2020.

(60) Provisional application No. 62/832,187, filed on Apr. 10, 2019.

(51) Int. Cl.
| | |
|---|---|
| *A61K 31/5377* | (2006.01) |
| *A61K 31/395* | (2006.01) |
| *A61K 31/416* | (2006.01) |
| *A61K 31/519* | (2006.01) |
| *A61K 31/52* | (2006.01) |
| *C12N 5/071* | (2010.01) |

(52) U.S. Cl.
CPC ........ *A61K 31/5377* (2013.01); *A61K 31/395* (2013.01); *A61K 31/416* (2013.01); *A61K 31/519* (2013.01); *A61K 31/52* (2013.01); *C12N 5/067* (2013.01); *C12N 2501/07* (2013.01); *C12N 2501/727* (2013.01)

(58) Field of Classification Search
None
See application file for complete search history.

(56) References Cited

FOREIGN PATENT DOCUMENTS

| WO | 2011/081942 A1 | 7/2011 |
| WO | 2016/118697 A1 | 7/2016 |
| WO | 2017/049386 A1 | 3/2017 |
| WO | 2018/204764 A1 | 11/2018 |
| WO | 2019/040471 A1 | 2/2019 |
| WO | 2019/071276 A1 | 4/2019 |

OTHER PUBLICATIONS

Yun et al., The Journal of Immunology, 2011, 186:563-575. (Year: 2011).*
PCT/US2018/055087—International Preliminary Report on Patentability, dated Apr. 16, 2020, 14 pages.
PCT/US20/27693—International Search Report and Written Opinion, dated Jul. 21, 2020, 17 pages.
Nakagawa et al., "SIRT5 Deacetylates carbamoyl phosphate synthetase 1 and regulates the urea cycle." Cell 137, No. 3 (2009): 560-570.
Wang et al., "Long noncoding RNA CPS1-IT1 suppresses the metastasis of hepatocellular carcinoma by regulating HIF-1a activity and inhibiting epithelial-mesenchymal transition." Oncotarget 7, No. 28 (2016): pp. 43588-43603.
çeliktas et al., "Role of CPS1 in cell growth, metabolism, and prognosis in LKB1-inactivated lung adenocarcinoma." JNCI: Journal of the National Cancer Institute 109, No. 3 (2017), 9 pages.
Wei et al., "IL-4 and IL-13 upregulate arginase I expression by cAMP and JAK/STAT6 pathways in vascular smooth muscle cells." American Journal of Physiology-Cell Physiology 279, No. 1 (2000): C248-C256.
Chiang et al., "Dysregulation of C/EBPa by mutant Huntingtin causes the urea cycle deficiency in Huntington's disease." Human molecular genetics 16, No. 5 (2007): 483-498.
PCT/US2018/055087—International Search Report and Written Opinion, dated Mar. 21, 2019, 21 pages.
Rajebhosale et al., "834 Designing Liver Cells Capable of Ammonia Detoxification Useful in Bio-Artificial Liver." Journal of Hepatology 52 (2010): S325-S326.
PCT/US20/27693—International Preliminary Report on Patentability, dated Apr. 16, 2020, 14 pages.

* cited by examiner

*Primary Examiner* — Allison M Fox
(74) *Attorney, Agent, or Firm* — Goodwin Procter LLP

(57) ABSTRACT

Provided are methods and compositions for the treating a patient with a urea cycle disorder. Methods and compositions are also provided for modulating genes encoding enzymes that participate in the urea cycle by altering gene signaling networks.

10 Claims, 36 Drawing Sheets

Specification includes a Sequence Listing.

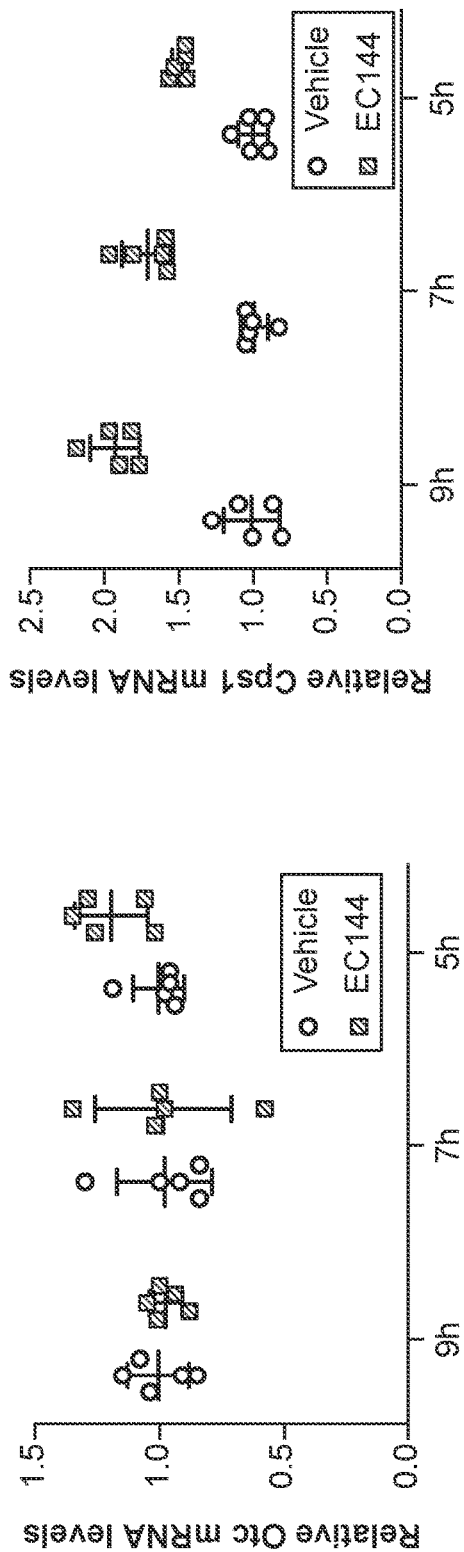
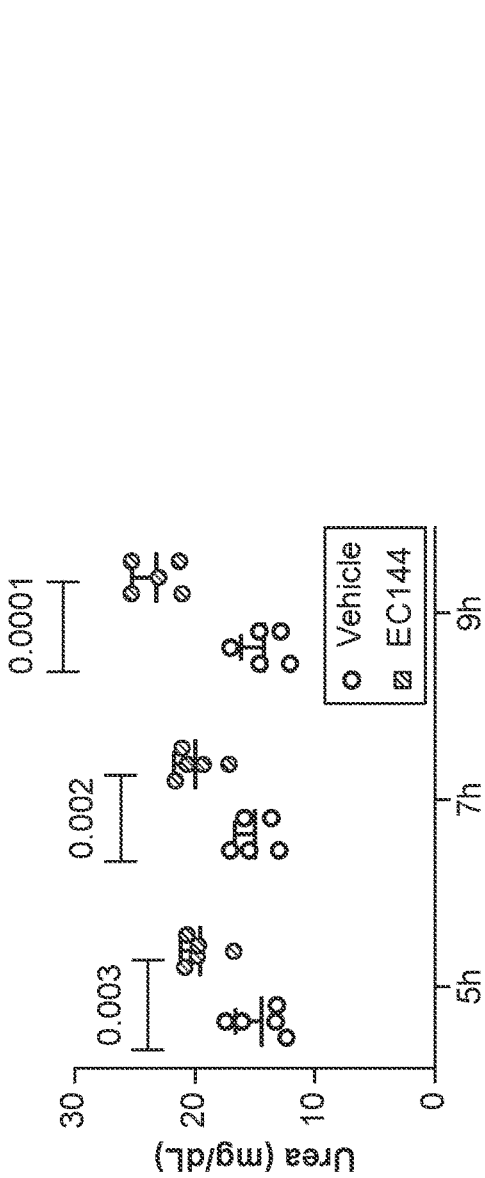
FIG. 33A
FIG. 33B
FIG. 33C

METHODS AND COMPOSITIONS FOR TREATING UREA CYCLE DISORDERS

RELATED APPLICATION DATA

This application is a continuation application of International Application No. PCT/US2020/027693, filed Apr. 10, 2020, which claims the benefit of U.S. Provisional Application No. 62/832,187, filed Apr. 10, 2019, which is hereby incorporated in its entirety by reference.

SEQUENCE LISTING

The instant application contains a Sequence Listing which has been submitted via EFS-Web and is hereby incorporated by reference in its entirety. Said ASCII copy, created on Dec. 14, 2020, is named CTC-017WOC1.txt and is 1,309,331 bytes in size.

BACKGROUND

Urea cycle disorders are a group of genetic disorders caused by defects in the metabolism of waste nitrogen via the urea cycle. The urea cycle is a cycle of biochemical reactions that produces urea from ammonia, a product of protein catabolism. The urea cycle mainly occurs in the mitochondria of liver cells. The urea produced by the liver enters the bloodstream where it travels to the kidneys and is ultimately excreted in urine. Genetic defects in any of the enzymes or transporters in the urea cycle can cause hyperammonemia (elevated blood ammonia), or the buildup of a cycle intermediate. Ammonia then reaches the brain through the blood, where it can cause cerebral edema, seizures, coma, long term disabilities in survivors, and/or death.

The onset and severity of urea cycle disorders is highly variable. It is influenced by the position of the defective protein in the cycle and the severity of the defect. Mutations that lead to severe deficiency or total absence of activity of any of the enzymes can result in the accumulation of ammonia and other precursor metabolites during the first few days of life. Because the urea cycle is the principal clearance system for ammonia, complete disruption of this pathway results in the rapid accumulation of ammonia and development of related symptoms. Mild to moderate mutations represent a broad spectrum of enzyme function, providing some ability to detoxify ammonia, and result in mild to moderate urea cycle disorders.

According to National Urea Cycle Disorders Foundation, the incidence of urea cycle disorders is estimated to be 1 in 8,500 live birth in the United States. The estimated incidence of individual urea cycle disorder varies from less than 1:2,000,000 to about 1:56,500 (See N A Mew et al., Urea Cycle Disorders Overview, 2015). They occur in both children and adults. These disorders are most often diagnosed in infancy, but some children do not develop symptoms until early childhood. Newborns with severe urea cycle disorders become catastrophically ill within 36-48 hours of life. In children with mild or moderate urea cycle disorders, symptoms may be seen as early as one year of age. Early symptoms include disliking meat or other high-protein foods, inconsolable crying, failure to thrive, mental confusion, and hyperactive behavior. Symptoms can progress to frequent episodes of vomiting, lethargy, delirium, and coma. Some individuals with mild urea cycle defects are diagnosed in adulthood. Ammonia accumulation may be triggered by illness or stress (e.g., viral infection, surgery, prolonged fasting, excessive exercising, and excessive dieting), resulting in multiple mild elevations of plasma ammonia concentration. Without proper diagnosis and treatment, these individuals are at risk for permanent brain damage, coma, and death.

Treatment for urea cycle disorders is a lifelong process. Symptoms are usually managed by using a combination of strategies including diet restriction, amino acid supplements, medications, dialysis, and/or hemofiltration. Dietary management is key to restricting the level of ammonia produced in the body. A careful balance of dietary protein, carbohydrates and fats is necessary to lower protein intake, while providing adequate calories for energy needs, as well as adequate essential amino acids for cell growth and development. Depending on the type of urea cycle disorder, amino acid supplements such as arginine or citrulline may be added to the diet. Sodium phenylbutyrate (BUPHENYL®), glycerol phenylbutyrate (RAVICTI®) and sodium benzoate are FDA approved drugs for the treatment of urea cycle disorders. They function as nitrogen binding agents to allow the kidneys to excrete excess nitrogen in place of urea. Dialysis and/or hemofiltration are used to quickly reduce plasma ammonia concentration to normal physiological level. When other treatment and management options fail, or for neonatal onset CPS1 and OTC deficiency, liver transplant is an option. Although the transplant alternative has been proven to be effective, the cost of the surgery, shortage of donors, and possible side effects of immunosuppressants can be difficult to overcome.

Therefore, there is a high unmet need for developing effective therapeutics for the treatment of urea cycle disorders. Provided herein are compositions and methods for the treatment of urea cycle disorders in humans.

SUMMARY

Provided herein are methods for increasing OTC gene expression in a cell harboring an OTC mutation associated with a partial reduction of OTC function, comprising: contacting the cell with an effective amount of a compound that increases CPS1 expression, wherein the compound inhibits a target selected from the group consisting of JAK1, JAK2, JAK3, HSP90, and IRF9.

In some embodiments, the cell is a hepatocyte.

In some embodiments, the target is JAK1, JAK2 or JAK3.

In some embodiments, the target is JAK1.

In some embodiments, the compound is selected from the group consisting of tofacitinib, momelotinib, baricitinib, upadacitinib, oclacitinib maleate, GLPG0634, GLPG0634 analog, LYS2784544, ruxolitinib, itacitinib, AZD1480, CP690550 citrate, cerdulatinib, decernotinib, peficitinib, and PF-06263276.

In some embodiments, the compound is tofacitinib.

In some embodiments, the target is HSP90

In some embodiments, the compound is selected from the group consisting of EC144, 17-AAG, BIIB021, HSP-990, retaspimycin hydrochloride (HCl), PF-0492911, luminespib, alvespimycin, and alvespimycin hydrochloride (HCl).

In some embodiments, the compound is EC144.

In some embodiments, compound is an siRNA compound that inhibits a target selected from the group consisting of JAK1, JAK2, JAK3, HSP90, and IRF9.

In some embodiments, the compound is an siRNA compound that inhibits IRF9.

In some embodiments, the OTC mutation is selected from the group consisting of the mutations appearing in Table 40 that are associated with non-zero percent enzyme activity.

In another aspect, provided herein are methods for increasing OTC expression in a human subject harboring an OTC mutation associated with a partial reduction of OTC function, comprising: administering to the subject an effective amount of a compound that increases CPS1 expression, wherein the compound inhibits a target selected from the group consisting of JAK1, JAK2, JAK3, HSP90, and IRF9.

In some embodiments, the subject is human.

In some embodiments, the target is JAK1, JAK2 or JAK3.

In some embodiments, the target is JAK1.

In some embodiments, the compound is selected from the group consisting of tofacitinib, momelotinib, baricitinib, upadacitinib, oclacitinib maleate, GLPG0634, GLPG0634 analog, LYS2784544, ruxolitinib, itacitinib, AZD1480, CP690550 citrate, cerdulatinib, decernotinib, peficitinib, and PF-06263276.

In some embodiments, the compound is tofacitinib.

In some embodiments, the target is HSP90

In some embodiments, the compound is selected from the group consisting of EC144, 17-AAG, BIIB021, HSP-990, retaspimycin hydrochloride (HCl), PF-0492911, luminespib, alvespimycin, and alvespimycin hydrochloride (HCl).

In some embodiments, the compound is EC144.

In some embodiments, compound is an siRNA compound that inhibits a target selected from the group consisting of JAK1, JAK2, JAK3, HSP90, and IRF9.

In some embodiments, the compound is an siRNA compound that inhibits IRF9.

In some embodiments, the OTC mutation is selected from the group consisting of the mutations appearing in Table 40 that are associated with non-zero percent enzyme activity.

In another aspect, provided herein are methods for increasing ureagenesis in a subject comprising any method disclosed herein.

In some embodiments, the compound increases a serum urea level in the subject as compared to administration of a control compound.

In some embodiments, the serum urea level is determined by a colorimetric chemical assay or photometric assay.

In some embodiments, the assay is performed on an AutoAnalyzer.

In some embodiments, the serum urea level is increased by about at least 5%, 10%, 20%, 30%, 40%, 50%, 60%, 70%, 80%, or 90%.

In some embodiments, the serum urea level is increased by about at least 10%.

A method for increasing ureagenesis in a cell comprising any method disclosed herein.

In some embodiments, the compound increases a urea level in the cell as compared to the urea level in an untreated cell.

In some embodiments, the urea level is determined by a colorimetric chemical assay or photometric assay.

In some embodiments, the assay is performed on an AutoAnalyzer.

In some embodiments, the serum urea level is increased by about at least 5%, 10%, 20%, 30%, 40%, 50%, 60%, 70%, 80%, or 90%.

In some embodiments, the serum urea level is increased by about at least 10%.

BRIEF DESCRIPTION OF THE DRAWINGS

FIG. 33A shows OTC gene expression after treatment with EC144. FIG. 33B shows CPS1 gene expression after treatment with EC144. FIG. 33C shows serum urea levels in vivo after treatment with an HSP90 inhibitor.

DETAILED DESCRIPTION

I. Introduction

Figure 1:
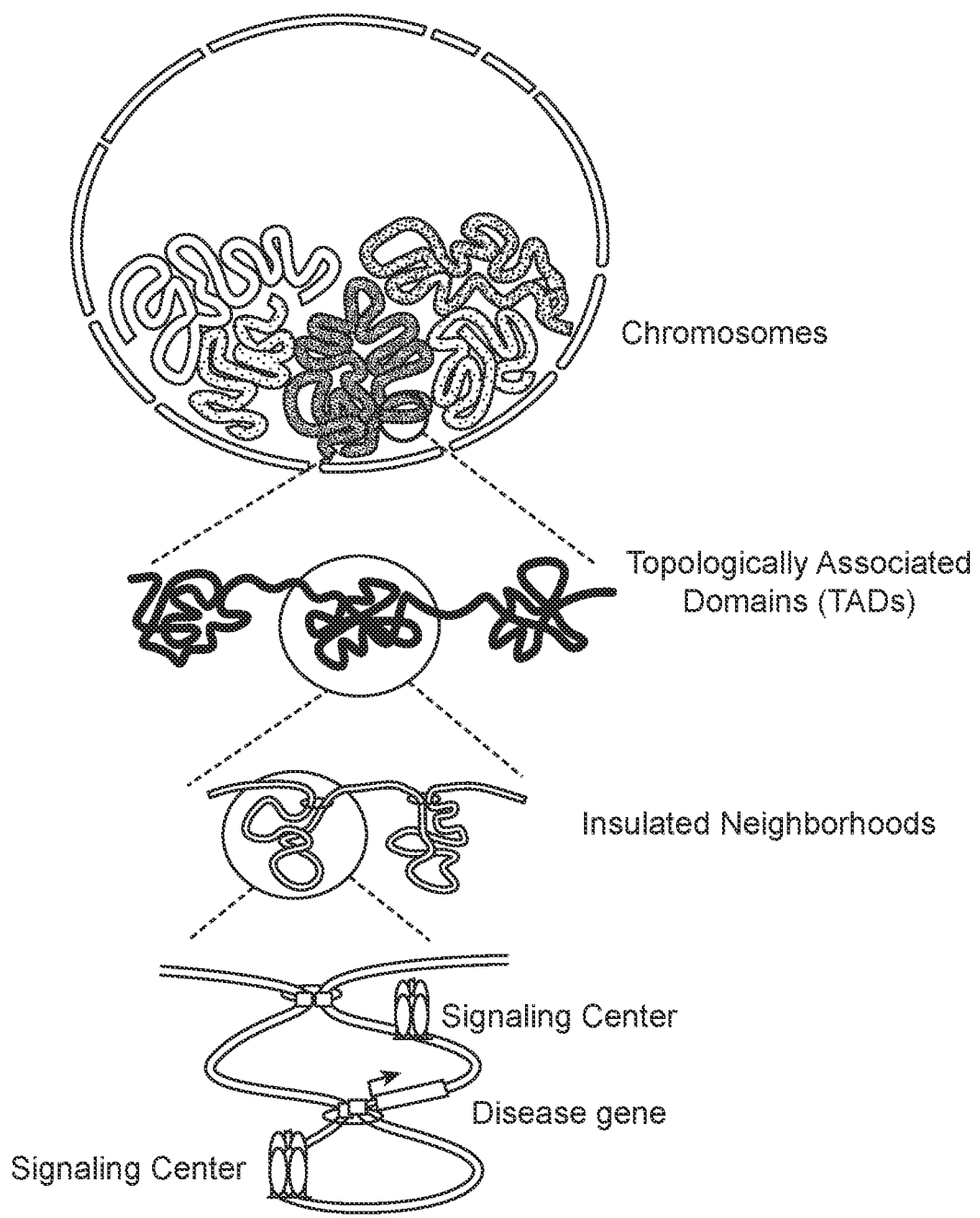
FIG. 1 illustrates the packaging of chromosomes in a nucleus, the localized topological domains into which chromosomes are organized, insulated neighborhoods in TADs and finally an example of an arrangement of a signaling center(s) around a particular disease gene.
Figure 2A:
FIG. 2A and FIG. 2B illustrate a linear and 3D arrangement of the CTCF boundaries of an insulated neighborhood.
Figure 2B:
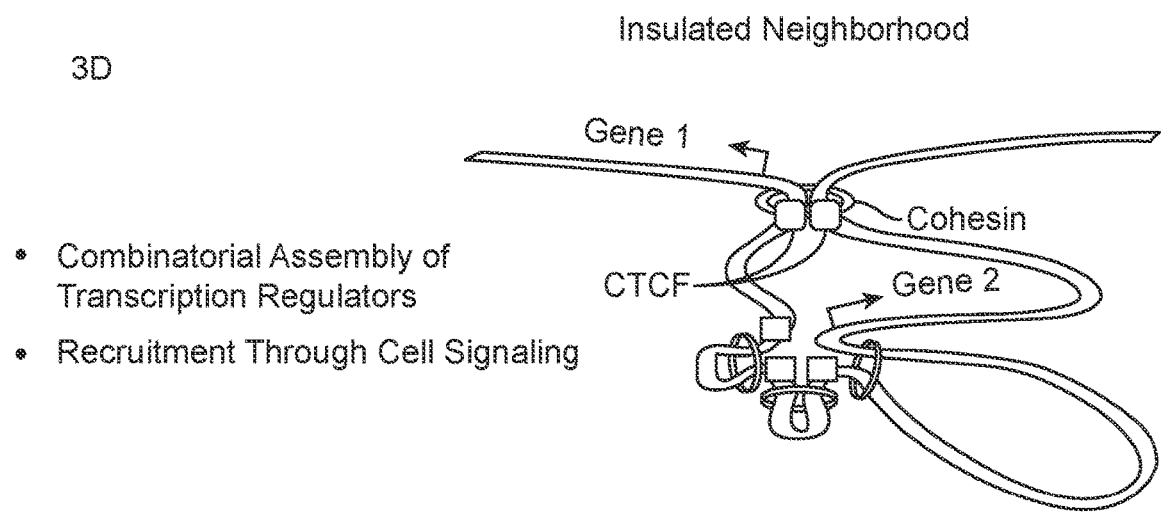
Figure 3A:
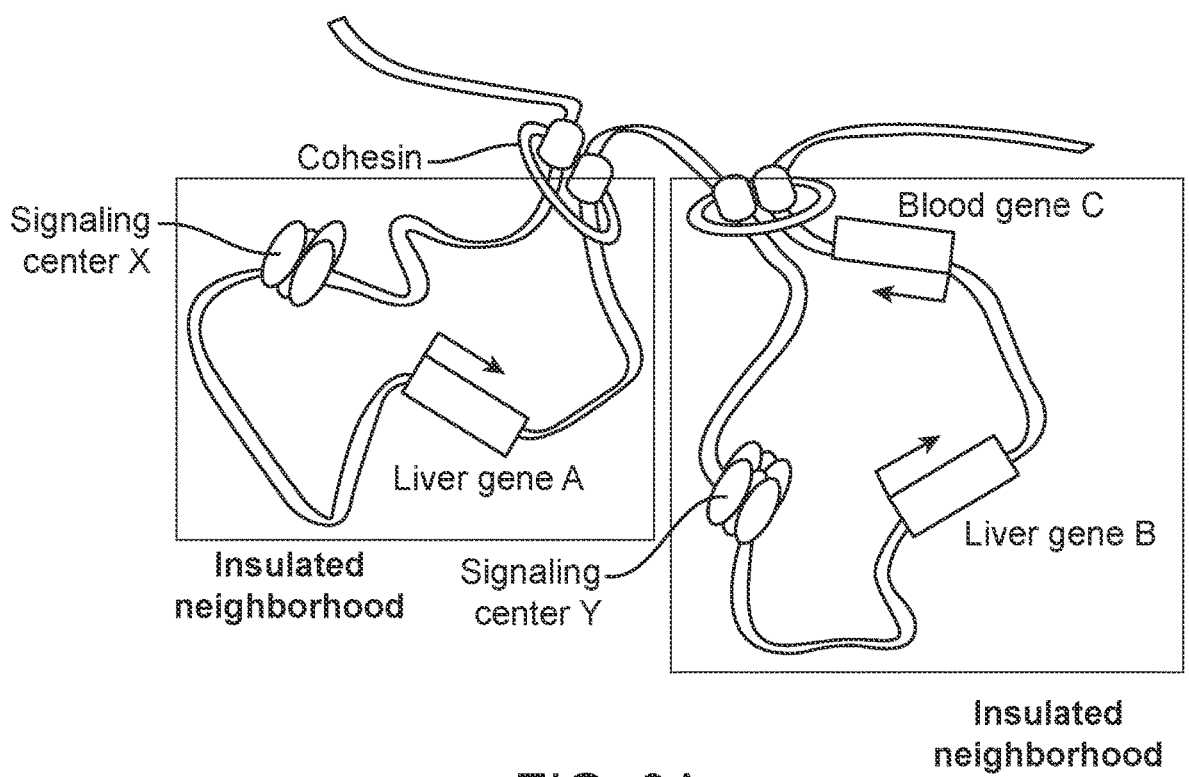
FIG. 3A and FIG. 3B illustrate tandem insulated neighborhoods and gene loops formed in such insulated neighborhoods.
Figure 3B:
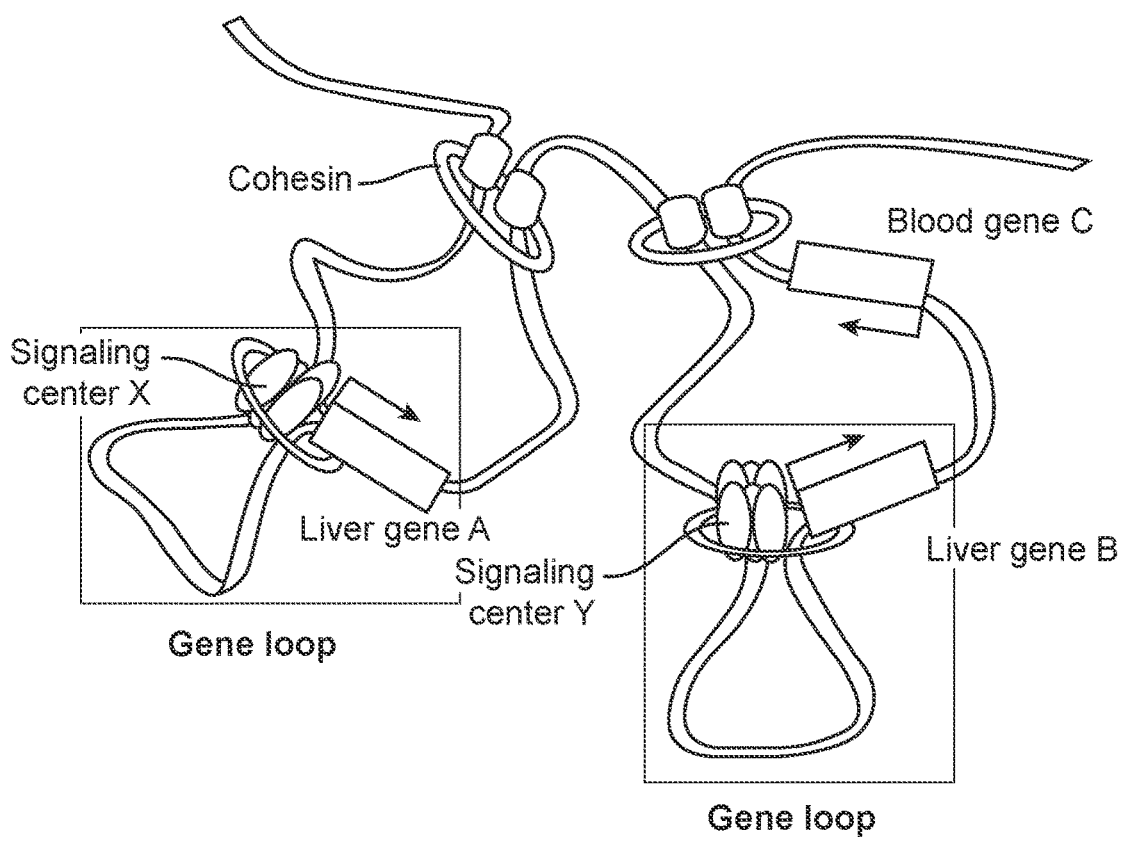
Figure 4:
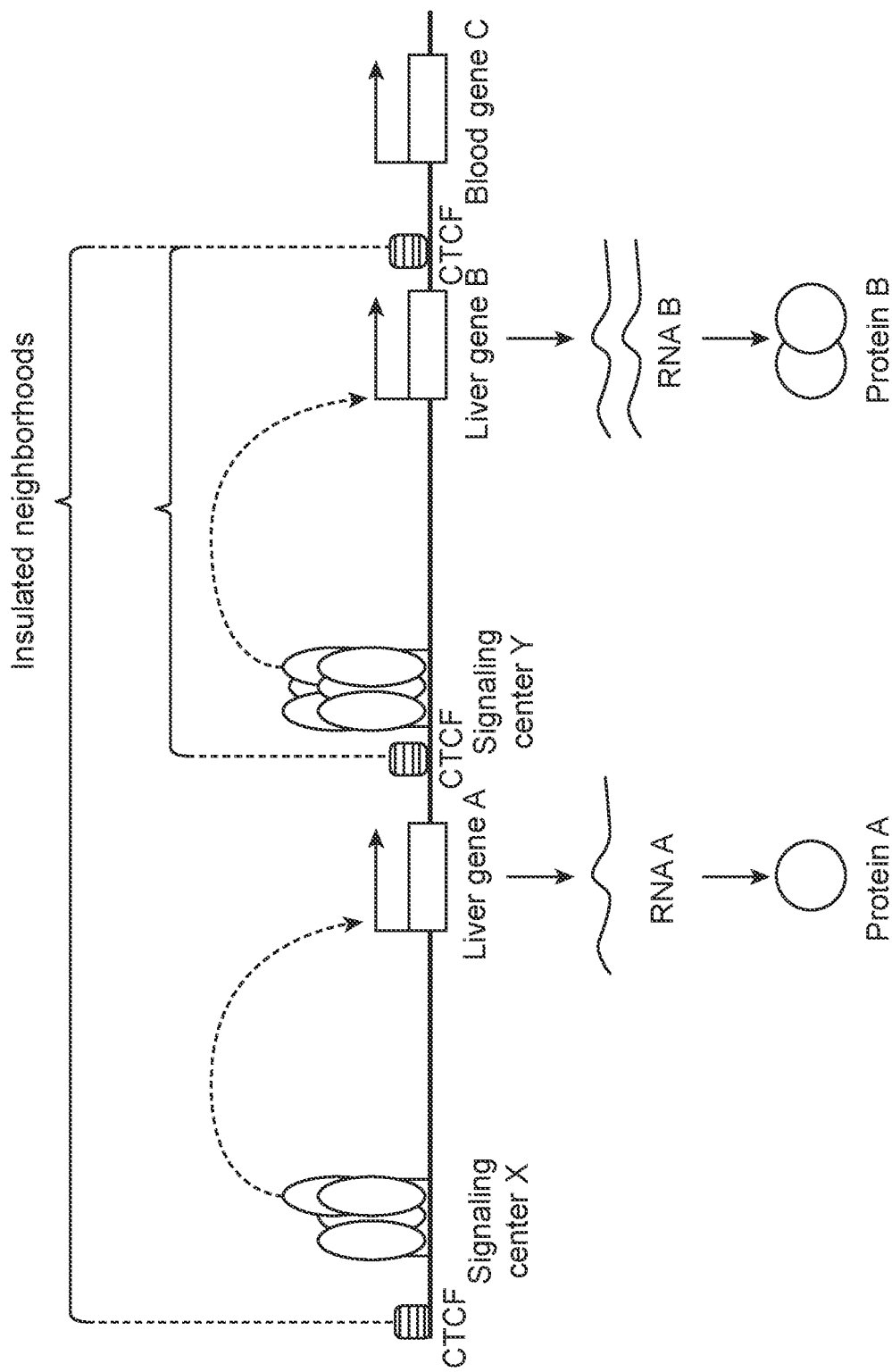
FIG. 4 illustrates the concept of an insulated neighborhood contained within a larger insulated neighborhood and the signaling which may occur in each.
Figure 5:
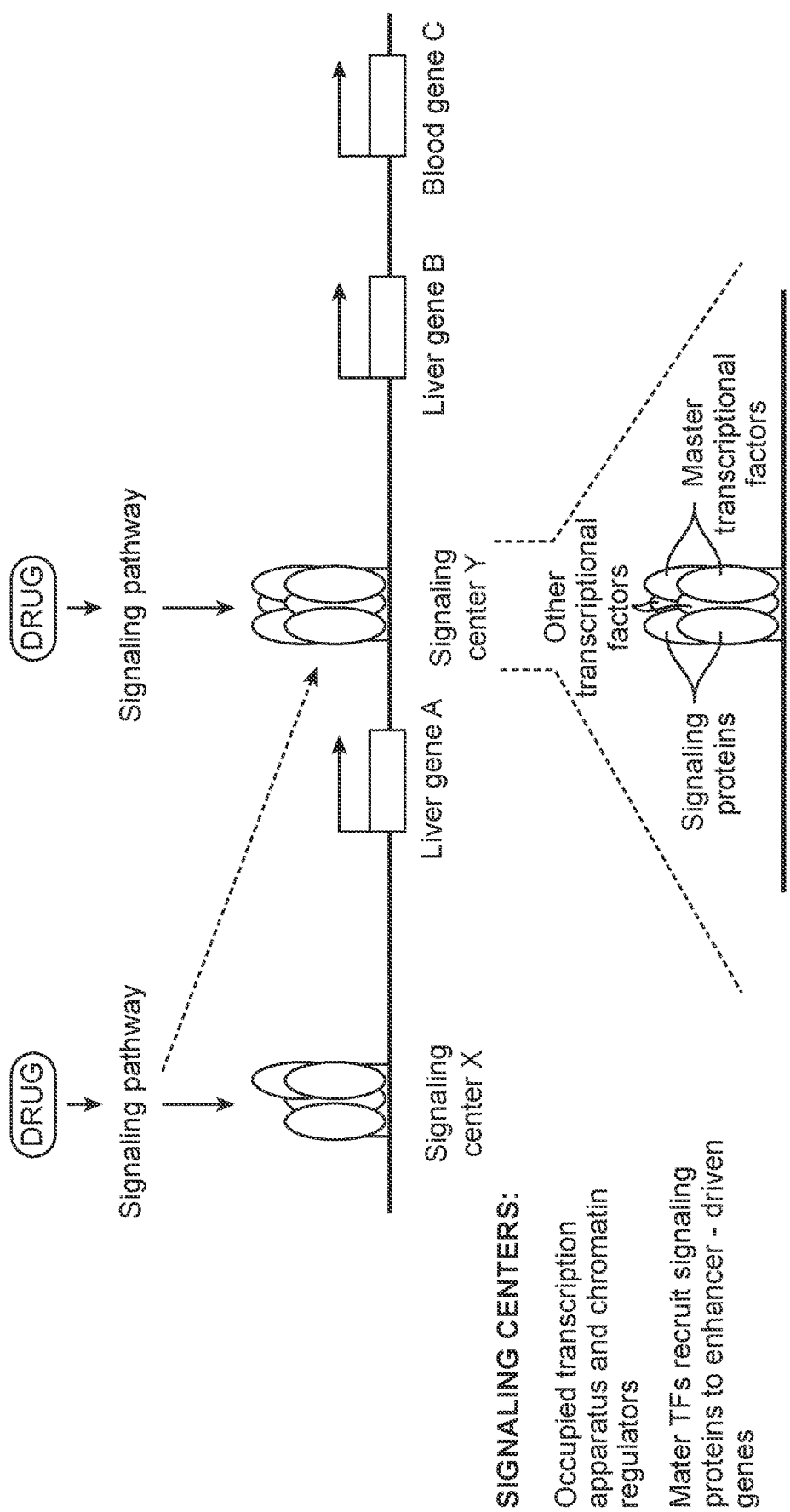
FIG. 5 illustrates the components of a signaling center; including transcriptional factors, signaling proteins, and/or chromatin regulators.

Provided herein are compositions and methods for the treatment of urea cycle disorders in mammalian subjects, particularly in human subjects. In particular, provided herein are compounds and related use for the modulation of at least one gene encoding a protein (e.g., an enzyme or a transporter) involved in the urea cycle.

Binding Sites for Signaling Molecules

A series of consensus binding sites, or binding motifs for binding sites, for signaling molecules has been identified by the present inventors. These consensus sequences reflect binding sites along a chromosome, gene, or polynucleotide for signaling molecules or for complexes which include one or more signaling molecules. These sites are provided by Table 11 of U.S. 62/501,795, which is hereby incorporated by reference in its entirety, and is reproduced below as Table 34 of the instant specification.

In some embodiments, binding sites are associated with more than one signaling molecule or complex of molecules. Further, non-limiting examples of such motifs or sites are also provided in Table 12 of U.S. 62/501,795, which is hereby incorporated by reference in its entirety, and is reproduced below as Table 35 of the instant specification.

It has further been determined that certain patterns are found in the binding motifs. A list of such patterns for complexes is provided by Tables 13 and 14 of U.S. 62/501,795, which is hereby incorporated by reference in its entirety, and for single molecules is provided in Tables 15 and 16 of U.S. 62/501,795, which is hereby incorporated by reference in its entirety. Each of these are reproduced below, respectively, as Tables 36-39 of the instant specification.

In the Motif Tables 13-16 of U.S. 62/501,795 which is hereby incorporated by reference in its entirety, certain designators are used according to the IUPAC nucleotide code. This code is shown in Table 17 of U.S. 62/501,795, which is hereby incorporated by reference in its entirety, and is reproduced below as Table 40 of the instant specification.

Table 18 of U.S. 62/501,795, which is hereby incorporated by reference in its entirety, provides a list of signaling molecules including those which act as transcription factors (TF) and/or chromatin remodeling factors (CR) that function in various cellular signaling pathways. The methods described herein may be used to inhibit or activate the expression of one or more signaling molecules associated with the regulatory sequence region of the primary neighborhood gene encoded within an insulated neighborhood. The methods may thus alter the signaling signature of one or more primary neighborhood genes which are differentially expressed upon treatment with the therapeutic agent compared to an untreated control.

Various embodiments of the transcripts encoding the signaling proteins of Table 18 of U.S. 62/501,795, which is hereby incorporated by reference in its entirety, contain internal stop codons. These internal stop codons result in translation of multiple polypeptides. In one embodiment, a polypeptide that is a fragment of the signaling proteins taught in Table 18 of U.S. 62/501,795 may have signaling properties. As a non-limiting example, the polypeptide may be a fragment such as SEQ ID NO: 9 and SEQ ID NO: 10 from SEQ ID NO: 11. As a non-limiting example, the polypeptide may be a fragment such as SEQ ID NO: 12 and SEQ ID NO: 13 from SEQ ID NO: 14. As a non-limiting example, the polypeptide may be a fragment such as SEQ ID NO: 15 and SEQ ID NO: 16 from SEQ ID NO: 17. As a non-limiting example, the polypeptide may be a fragment such as SEQ ID NO: 18-19 from SEQ ID NO: 20. As a non-limiting example, the polypeptide may be a fragment such as SEQ ID NO: 21 and SEQ ID NO: 22 from SEQ ID NO: 23. As a non-limiting example, the polypeptide may be a fragment such as SEQ ID NO: 24 and SEQ ID NO: 25 from SEQ ID NO: 26. As a non-limiting example, the polypeptide may be a fragment such as SEQ ID NO: 27 and SEQ ID NO: 28 from SEQ ID NO: 29. As a non-limiting example, the polypeptide may be a fragment such as SEQ ID NO: 30 and SEQ ID NO: 31 from SEQ ID NO: 32. As a non-limiting example, the polypeptide may be a fragment such as SEQ ID NO: 33-37 from SEQ ID NO: 38. Table 18 of U.S. 62/501,795 is reproduced below as Table 41 of the instant specification.

In some embodiments, at least one compound selected from Tables 19-21, of U.S. 62/501,795, which are hereby incorporated by reference in their entirety, and Tables 22-26 and 28 of U.S. 62/501,795, which are hereby incorporated by reference in their entirety, may be used to modulate RNAs derived from regulatory sequence regions to alter or elucidate the gene signaling networks of the present disclosure.

II. Urea Cycle Disorders and Related Genes

Compositions and methods described herein may be used to treat one or more urea cycle disorders. As used herein, the term "urea cycle disorder" refers to any disorder that is caused by a defect or malfunction in the urea cycle. The urea cycle is a cycle of biochemical reactions that produces urea from ammonia, a product of protein catabolism. It is composed of 5 key enzymes including carbamoyl phosphate synthetase 1 (CPS1), ornithine transcarbamylase (OTC), argininosuccinate synthetase (ASS1), argininosuccinate lyase (ASL), and arginase 1 (ARG1), but also requires other enzymes, such as N-acetylglutamate synthetase (NAGS), and mitochondrial amino acid transporters, such as ornithine translocase (ORNT1) and citrin.

As used herein, a "urea cycle-related gene" refers to a gene whose gene product (e.g., RNA or protein) is involved in the urea cycle. Urea cycle-related genes include, but are not limited to, CPS1 (encoding CPS1), OTC (encoding OTC), ASS1 (encoding ASS1), NAGS (encoding NAGS), ARG1 (encoding ARG1), SLC25A15 (encoding ORNT1), and SLC25A13 (encoding citrin). Mutations in the urea cycle-related genes or their regulatory regions may lead to production of dysfunctional proteins and disruption of the urea cycle. In some cases, patients with a urea cycle disorder may carry a single functional allele and a mutated allele of a urea cycle-related gene. This results in the production of insufficient amount of the functional protein. The phenomenon is known as "haploinsufficiency."

The urea cycle mainly occurs in the mitochondria of liver cells. The urea produced by the liver enters the bloodstream where it travels to the kidneys and is ultimately excreted in urine. Genetic defects in any of the enzymes or transporters in the urea cycle can cause hyperammonemia (elevated blood ammonia), or the buildup of a cycle intermediate. Ammonia then reaches the brain through the blood, where it can cause cerebral edema, seizures, coma, long term disabilities in survivors, and/or death.

The onset and severity of urea cycle disorders is highly variable. It is influenced by the position of the defective protein in the cycle and the severity of the defect. Mutations that lead to severe deficiency or total absence of activity of any of the first four enzymes in the pathway (CPS1, OTC, ASS1, and ASL) or the cofactor producer (NAGS) can result in the accumulation of ammonia and other precursor metabolites during the first few days of life. Because the urea cycle is the principal clearance system for ammonia, complete disruption of this pathway results in the rapid accumulation of ammonia and development of related symptoms. Mild to moderate mutations represent a broad spectrum of enzyme function, providing some ability to detoxify ammonia, and result in mild to moderate urea cycle disorders.

According to National Urea Cycle Disorders Foundation, the incidence of urea cycle disorders is estimated to be 1 in 8,500 live birth in the United States. The estimated incidence of individual urea cycle disorder varies from less than 1:2,000,000 to about 1:56,500 (See NA Mew et al., Urea Cycle Disorders Overview, 2015, which is incorporated by reference in its entirety). They occur in both children and adults. These disorders are most often diagnosed in infancy, but some children do not develop symptoms until early childhood. Newborns with severe urea cycle disorders become catastrophically ill within 36-48 hours of life. In children with mild or moderate urea cycle disorders, symptoms may be seen as early as one year of age. Early symptoms include disliking meat or other high-protein foods, inconsolable crying, failure to thrive, mental confusion or hyperactive behavior. Symptoms can progress to frequent episodes of vomiting, lethargy, delirium, and coma. Some individuals with mild urea cycle defects are diagnosed in adulthood. Ammonia accumulation may be triggered by illness or stress (e.g., viral infection, surgery, prolonged fasting, excessive exercising, and excessive dieting), resulting in multiple mild elevations of plasma ammonia concentration. Without proper diagnosis and treatment, these individuals are at risk for permanent brain damage, coma, and death.

Treatment for urea cycle disorders is a lifelong process. Symptoms are usually managed by using a combination of strategies including diet restriction, amino acid supplements, medications, dialysis, and/or hemofiltration. Dietary management is key to restricting the level of ammonia produced in the body. A careful balance of dietary protein, carbohydrates and fats is necessary to lower protein intake, while providing adequate calories for energy needs, as well as adequate essential amino acids for cell growth and development. Depending on the type of urea cycle disorder, amino acid supplements such as arginine or citrulline may be added to the diet. Sodium phenylbutyrate (BUPHENYL®), glycerol phenylbutyrate (RAVICTI®) and sodium benzoate are FDA approved drugs for the treatment of urea cycle disorders. They function as nitrogen binding agents to allow the kidneys to excrete excess nitrogen in place of urea. Dialysis and/or hemofiltration are used to quickly reduce plasma ammonia concentration to normal physiological level. When other treatment and management options fail, or for neonatal onset CPS1 and OTC deficiency, liver transplant is an option. Although the transplant alternative has been proven to be effective, the cost of the surgery, shortage of donors, and possible side effects of immunosuppressants can be difficult to overcome.

Specific types of urea cycle disorder include, but are not limited to, Phosphate Synthetase 1 (CPS1) deficiency, Ornithine Transcarbamylase (OTC) deficiency, Argininosuccinate Synthetase (ASS1) deficiency, Argininosuccinate Lyase (ASL) deficiency, Arginase-1 (ARG1) deficiency, N-Acetylglutamate Synthetase (NAGS) deficiency, Ornithine translocase (ORNT1) deficiency, and Citrin deficiency. Any one or more of these disorders may be treated or targeted by the compositions and methods described herein.

Carbamoyl Phosphate Synthetase 1 (CPS1) Deficiency

In some embodiments, methods and compositions provided herein may be used to treat Carbamoyl Phosphate Synthetase 1 (CPS1) deficiency. CPS1 deficiency (MIM #237300) is an autosomal recessive disorder caused by mutations in the CPS1 gene. CPS1 catalyzes the synthesis of carbamoyl phosphate from ammonia and bicarbonate. CPS1 deficiency is the most severe type of the urea cycle disorders. Approximately 10 mutations that cause CPS1 deficiency have been identified in the CPS1 gene. Individuals with complete CPS1 deficiency rapidly develop hyperammonemia in the newborn period. Children who are successfully rescued from crisis are chronically at risk for repeated episodes of hyperammonemia.

In some embodiments, methods provided herein involve modulating the expression of the CPS1 gene. CPS1 may also be referred to as Carbamoyl-Phosphate Synthase 1, Mitochondrial; Carbamoyl-Phosphate Synthase (Ammonia); EC 6.3.4.16; Carbamoyl-Phosphate Synthase [Ammonia], Mitochondrial; Carbamoyl-Phosphate Synthetase I; Carbamoylphosphate Synthetase I; CPSase I; CPSASE1; and PHN. The CPS1 gene has a cytogenetic location of 2q34 and the genomic coordinate are on Chromosome 2 on the forward strand at position 210,477,682-210,679,107. LANCL1-AS1 (ENSG00000234281) and LANCL1 (ENSG00000115365) are the genes upstream of CPS1 and LOC107985978 is the gene downstream of CPS1. CPS1-IT1 (ENSG00000280837) is a gene located within CPS1 on the forward strand. The CPS1 gene has a NCBI gene ID of 1373, Uniprot ID of P31327 and Ensembl Gene ID of ENSG00000021826. The genomic sequence of CPS1 is shown as in SEQ ID NO: 1.

Ornithine Transcarbamylase (OTC) Deficiency

In some embodiments, methods and compositions provided herein may be used to treat Ornithine Transcarbamylase (OTC) deficiency. OTC deficiency (MIM #311250) is an X-linked genetic disorder caused by mutations in the OTC gene. OTC catalyzes the reaction between carbamoyl phosphate and ornithine to form citrulline and phosphate. More than 500 OTC gene mutations have been identified in people with OTC deficiency. The severe, early-onset form of the disorder, caused by complete absence of OTC activity, usually affects males. This form is as severe as CPS1 deficiency. The later-onset form of the disorder occurs in both males and females. These individuals develop hyperammonemia during their lifetime and many require chronic medical management for hyperammonemia.

In some embodiments, methods provided herein involve modulating the expression of the OTC gene. OTC may also be referred to as Ornithine Carbamoyltransferase; Ornithine Transcarbamylase; EC 2.1.3.3; OTCase, Ornithine Carbamoyltransferase, Mitochondrial; EC 2.1.3; and OCTD. The OTC gene has a cytogenetic location of Xp11.4 and the genomic coordinate are on Chromosome X on the forward strand at position 38,352,545-38,421,450. RPGR (ENSG00000 156313) is the gene upstream of OTC and LOC392442 is the gene downstream of OTC. TDGF1P1 (ENSG00000227988) is the gene located within OTC on the reverse strand. The OTC gene has a NCBI gene ID of 5009, Uniprot ID of P00480 and Ensembl Gene ID of ENSG00000036473. The genomic sequence of OTC is shown as in SEQ ID NO: 2.

Argininosuccinate Synthetase (ASS1) Deficiency

In some embodiments, methods and compositions provided herein may be used to treat Argininosuccinate Synthetase (ASS1) deficiency. ASS1 deficiency (MIM #215700), also known as Citrullinemia type I, is an autosomal recessive disorder caused by mutations in the ASS1 gene. ASS1 catalyzes the synthesis of argininosuccinate from citrulline and aspartate. About 118 mutations that cause ASS1 deficiency have been identified in the ASS1 gene. The early onset form of this disorder can also be quite severe. The symptoms associated with hyperammonemia are life-threatening in many cases. Affected individuals are able to incorporate some waste nitrogen into urea cycle intermediates, which makes treatment slightly easier than in the other urea cycle disorders.

In some embodiments, methods provided herein involve modulating the expression of the ASS1 gene. ASS1 may also be referred to as EC 6.3.4.5, Argininosuccinate Synthase, ASS, Argininosuccinic Acid Synthetase 1, Argininosuccinate Synthetase 1, Argininosuccinate Synthetase, Citrulline-Aspartate Ligase, and CTLN1. The ASS1 gene has a cytogenetic location of 9q34.11 and the genomic coordinate are on Chromosome 9 on the forward strand at position 130,444,929-130,501,274. HMCN2 (ENSG00000148357) and LOC107987134 are the genes upstream of ASS1, and FUBP3 (ENSG00000107164) and LOC100272217 are the genes downstream of ASS1. LOC105376294 is the gene that overlaps with the 3' region of ASS1 on the reverse strand. The ASS1 gene has a NCBI gene ID of 445, Uniprot ID of P00966 and Ensembl Gene ID of ENSG00000130707. The genomic sequence of ASS1 is shown as in SEQ ID NO: 3.

Argininosuccinate Lyase (ASL) Deficiency

In some embodiments, methods and compositions provided herein may be used to treat Argininosuccinate Lyase (ASL) deficiency. ASL deficiency (MIM #207900) is an autosomal recessive disorder caused by mutations in the ASL gene. ASL cleaves argininosuccinic acid to produce arginine and fumarate in the fourth step of the urea cycle. More than 30 different mutations in the ASL gene have been identified worldwide. This disorder has a severe neonatal onset form and a late onset form. The severe neonatal onset form is indistinguishable from that of other urea cycle disorders. The late onset form ranges from episodic hyperammonemia triggered by acute infection or stress to cognitive impairment, behavioral abnormalities, and/or learning disabilities in the absence of any documented episodes of hyperammonemia.

In some embodiments, methods provided herein involve modulating the expression of the ASL gene. ASL may also be referred to as Argininosuccinase, EC 4.3.2.1, ASAL, and Argininosuccinase. The ASL gene has a cytogenetic location of 7q11.21 and the genomic coordinate are on Chromosome 7 on the forward strand at position 66,075,798-66,093,558. LOC644667 is the gene upstream of ASL and CRCP (ENSG00000241258) is the genes downstream of ASL. The ASL gene has a NCBI gene ID of 435, Uniprot ID of P04424 and Ensembl Gene ID of ENSG00000126522. The genomic sequence of ASL is shown as in SEQ ID NO: 4.

N-Acetylglutamate Synthetase (NAGS) Deficiency

In some embodiments, methods and compositions provided herein may be used to treat N-Acetylglutamate Synthetase (NAGS) deficiency. NAGS deficiency (MIM #237310) is an autosomal recessive disorder caused by mutations in the NAGS gene. NAGS catalyzes the production of N-Acetylglutamate (NAG) from glutamate and acetyl-CoA. NAG is a cofactor of CPS1. Approximately 12 mutations in the NAGS gene have been identified in people with NAGS deficiency. Symptoms of NAGS deficiency mimic those of CPS1 deficiency, as CPS1 is rendered inactive in the absence of NAG.

In some embodiments, methods provided herein involve modulating the expression of the NAGS gene. NAGS may also be referred to as Amino-Acid Acetyltransferase, N-Acetylglutamate Synthase, Mitochondrial, EC 2.3.1.1, AGAS, and ARGA. The NAGS gene has a cytogenetic location of 17q21.31 and the genomic coordinate are on Chromosome 17 on the forward strand at position 44,004,546-44,009,063. PPY (ENSG00000108849) is the gene upstream of NAGS and TMEM101 (ENSG00000091947) is the genes downstream of NAGS. PYY (ENSG00000131096) is a gene that overlaps with NAGS on the reserve strand. The NAGS gene has a NCBI gene ID of 162417, Uniprot ID of Q8N159 and Ensembl Gene ID of ENSG00000161653. The genomic sequence of NAGS is shown as in SEQ ID NO: 5.

Arginase-1 (ARG1) Deficiency

In some embodiments, methods and compositions provided herein may be used to treat Arginase-1 (ARG1) deficiency. ARG1 deficiency (MIM #207800) is an autosomal recessive disorder caused by mutations in the ARG1 gene. ARG1 catalyzes the hydrolysis of arginine to ornithine and urea, which is the final step in the urea cycle. More than 40 mutations have been found in the ARG1 gene that cause partial or complete loss of enzyme function. Defects in ARG1 cause hyperargininemia, a more subtle disorder involving neurologic symptoms. Arginase deficiency usually becomes evident by about the age of 3. It most often appears as stiffness, especially in the legs, caused by abnormal tensing of the muscles (spasticity). Other symptoms may include slower than normal growth, developmental delay and eventual loss of developmental milestones, intellectual disability, seizures, tremor, and difficulty with balance and coordination (ataxia). Occasionally, high protein meals or stress caused by illness or periods without food (fasting) may cause ammonia to accumulate more quickly in the blood. This rapid increase in ammonia may lead to episodes of irritability, refusal to eat, and vomiting. In some affected individuals, signs and symptoms of arginase deficiency may be less severe, and may not appear until later in life. Hyperammonemia is rare or usually not severe in Arginase deficiency. Arginase deficiency is a very rare disorder; it has been estimated to occur once in every 300,000 to 1,000,000 individuals.

In some embodiments, methods provided herein involve modulating the expression of the ARG1 gene. ARG1 may also be referred to as Liver-Type Arginase; Type I Arginase; Arginase, liver; and EC 3.5.3.1. The ARG1 gene has a cytogenetic location of 6q23.2 and the genomic coordinate are on Chromosome 6 on the forward strand at position 131,573,144-131,584,332. RPL21P67 (ENSG0000-0219776) is the gene upstream of ARG1 and ENPP3 (ENSG00000154269) is the genes downstream of ARG1 MED23 (ENSG00000112282) is a gene that overlaps with ARG1 on the reserve strand. The ARG1 gene has a NCBI gene ID of 383, Uniprot ID of P05089 and Ensembl Gene ID of ENSG00000118520. The genomic sequence of ARG1 is shown as in SEQ ID NO: 6.

Ornithine Translocase (ORNT1) Deficiency

In some embodiments, methods and compositions provided herein may be used to treat Ornithine translocase (ORNT1) deficiency. ORNT1 deficiency (MIM #238970), also known as the hyperornithinemia-hyperammonemia-homocitrullinuria (HHH) syndrome, is an autosomal recessive disorder caused by mutations in the SLC25A15 gene. ORNT1 is a transporter protein that transports ornithine across the inner mitochondrial membrane to the mitochondrial matrix, where it participates in the urea cycle. Failure to transport ornithine results in an interruption of the urea cycle and the accumulation of ammonia. Approximately 17 mutations in the SLC25A15 gene have been identified in individuals with ORNT1 deficiency, including F188delta, E180K, T32R, Q89X, G27R, G190D, R275Q, and a 13q14 microdeletion, etc (Camacho et al., Nat Genet. 1999 June; 22(2):151-8; Camacho et al., Pediatric Research (2006) 60, 423-429; Salvi et al., Human Mutation, Mutation in Brief #457 (2001), which are hereby incorporated by reference in their entirety). Affected newborns typically present with lethargy, muscular hypotonia, and seizures. If untreated, death occurs within the first few days. The majority of survivors have pyramidal tract signs, with spastic paraparesis (Lemay et al., J Pediatr. 1992 November; 121(5 Pt 1): 725-30, Salvi et al., Neurology. 2001; 57(5):911, which are hereby incorporated by reference in their entirety). Most have myoclonic seizures, ataxia, and mental retardation. A milder form of the disorder has been reported in adults, who become symptomatic following protein-rich meals.

In some embodiments, methods provided herein involve modulating the expression of the SLC25A15 gene. SLC25A15 may also be referred to as Solute Carrier Family 25 Member 15, Solute Carrier Family 25 (Mitochondrial Carrier; Ornithine Transporter) Member 15, Ornithine Transporter 1, ORNT1, Mitochondrial Ornithine Transporter 1, D135327, ORC1, and HHH. SLC25A15 has a cytogenetic location of 13q14.11 and the genomic coordinate are on Chromosome 13 on the forward strand at position 40,789,412-40,810,111. MRPS31 (ENSG000-00102738) is the gene upstream of SLC25A15 and MIR621 (ENSG00000207652) is the genes downstream of SLC25A15. TPTE2P5 (ENSG00000168852) is a gene that overlaps with SLC25A15 on the reserve strand. SLC25A15 has a NCBI gene ID of 10166, Uniprot ID of Q9Y619 and Ensembl Gene ID of ENSG00000102743. The genomic sequence of SLC25A15 is shown as in SEQ ID NO: 7.

Citrin Deficiency

In some embodiments, methods and compositions provided herein may be used to treat Citrin deficiency. Citrin deficiency (neonatal-onset MIM #605814 and adult-onset #603471), also known as Citrullinemia type II, is an autosomal recessive disorder caused by mutations in the SLC25A13 gene. Citrin is a transporter protein responsible for the transport of aspartate into the urea cycle. The loss of citrin blocks the aspartate transport and decrease the ability of ASS to produce argininosuccinate. More than 20 mutations in the SLC25A13 gene have been identified in people with adult-onset type II citrullinemia. It can manifest in newborns as neonatal intrahepatic cholestasis caused by citrin deficiency (NICCD), in older children as failure to thrive and dyslipidemia caused by citrin deficiency (FTTDCD), and in adults as recurrent hyperammonemia with neuropsychiatric symptoms in citrullinemia type II (CTLN2). Citrin deficiency as a cause of neonatal intrahepatic cholestasis occurs almost exclusively in Asian infants (Yeh et al., J Pediatr 2006; 148:642; Zhang et al., Tohoku J Exp Med. 2014 August; 233(4):275-81; Tzun and Marques., EC Paediatrics 2.5 (2016); Lin et al., Sci Rep. 2016 Jul. 11; 6:29732; which are hereby incorporated by reference in their entirety). Adult-onset form of this disease is characterized by fatty liver, hyperammonemia, and neurological symptoms (Yasuda et a., Hum Genet 2000; 107:537; Lee et al., J Pediatr Gastroenterol Nutr 2010; 50:682, which are hereby incorporated by reference in their entirety).

In some embodiments, methods provided herein involve modulating the expression of the SLC25A13 gene. SLC25A13 may also be referred to as Solute Carrier Family 25 Member 13, Mitochondrial Aspartate Glutamate Carrier 2, Solute Carrier Family 25 (Aspartate/Glutamate Carrier) Member 13, ARALAR2, CITRIN, Calcium-Binding Mitochondrial Carrier Protein Aralar2, and CTLN2. SLC25A13 has a cytogenetic location of 7q21.3 and the genomic coordinate are on Chromosome 7 on the reverse strand at position 96,120,220-96,322,147. DYNC1I1 (ENSG00000158560) is the gene upstream of SLC25A13 and RNU6-532P (ENSG00000207045) is the gene downstream of SLC25A13. CYCSP18, MIR591 (ENSG00000208025), and RPL21P74 are genes located within SLC25A13. SLC25A13 has a NCBI gene ID of 10165, Uniprot ID of Q9UJS0 and Ensembl Gene ID of ENSG00000004864. The genomic sequence of SLC25A13 is shown as in SEQ ID NO: 8.

Ureagenesis

Provided herein are methods of increasing ureagenesis in a cell or subject, comprising administering to the subject or contacting the cell with an effective amount of a compound capable of modulating the expression of one or more genes selected from Carbamoyl Phosphate Synthetase 1 (CPS1), Ornithine Transcarbamylase (OTC), Argininosuccinate Synthetase 1 (ASS1), Argininosuccinate Lyase (ASL), N-Acetylglutamate Synthetase (NAGS), Arginase 1 (ARG1), Solute Carrier Family 25 Member 15 (SLC25A15), and Solute Carrier Family 25 Member 13 (SLC25A13). In some embodiments, the method comprises increasing OTC expression by administering a compound that increases CPS1 expression. In some embodiments, the compound modulates a target selected from JAK1, JAK2, JAK3, STAT5A, STAT5B, HSP90, or IRF9.

An increase in ureagenesis can result in an increase in a serum urea level in a subject, or a urea level in a cell. In some embodiments, the increase in urea level in a subject is as compared to administration of a control compound. In some embodiments, the increase in urea level in a subject is as compared to the urea level prior to administration of the compound that increases a urea cycle gene. In some embodiments, the increase in urea level in a cell is as compared to the urea level in an untreated cell.

In some embodiments, ureagenesis in a subject or cell is increased after administration of a JAK1, JAK2, JAK3, HSP90, MAPK, EGFR, FGFR, BRAF, RAF1, KDR, FLT1, TBK1, IKBKE, PRKAA1, PRKAA2, PRKAB1, BMPR1A, BMPR1B, JAK1, JAK2, JAK3, HSP90, MAPK, EGFR, FGFR, ABL, HER2, or HIF1a inhibitor. In some embodiments, ureagenesis in a subject or cell is increased after administration of a JAK1 inhibitor. In some embodiments, ureagenesis in a subject or cell is increased after administration of a JAK2 inhibitor. In some embodiments, ureagenesis in a subject or cell is increased after administration of a JAK3 inhibitor. In some embodiments, ureagenesis in a subject or cell is increased after administration of an HSP90 inhibitor. In some embodiments, ureagenesis in a subject or cell is increased after administration of a STAT5B inhibitor. In some embodiments, ureagenesis in a subject or cell is increased after administration of a STAT5A inhibitor. In some embodiments, ureagenesis in a subject or cell is increased after administration of an IRF9 inhibitor.

The methods described herein can increase the serum urea level in a subject by about at least 1%, 5%, 10%, 15%, 20%, 25%, 30%, 35%, 40%, 45%, 50%, 55%, 60%, 65%, 70%, 75%, 80%, 85%, 90%, 95%, 100%, or more in the subject as compared to administration of a control compound. The methods described herein can increase the serum urea level in a subject by about at least 1%, 5%, 10%, 15%, 20%, 25%, 30%, 35%, 40%, 45%, 50%, 55%, 60%, 65%, 70%, 75%, 80%, 85%, 90%, 95%, 100%, or more in the subject as compared to administration of a control compound as compared to the urea level prior to administration of the compound that increases a urea cycle gene. The methods described herein can increase the serum urea level in a cell, by about at least 1%, 5%, 10%, 15%, 20%, 25%, 30%, 35%, 40%, 45%, 50%, 55%, 60%, 65%, 70%, 75%, 80%, 85%, 90%, 95%, 100%, or more in the cell as compared to the urea level in an untreated cell. In some embodiments, the urea level is increased by about at least 1%. In some embodiments, the urea level is increased by about at least 5%. In some embodiments, the urea level is increased by about at least 10%. In some embodiments, the urea level is increased by about at least 20%. In some embodiments, the urea level is increased by about at least 30%. In some embodiments, the urea level is increased by about at least 40%. In some embodiments, the urea level is increased by about at least 50%. In some embodiments, the urea level is increased by about at least 60%. In some embodiments, the urea level is increased by about at least 70%. In some embodiments, the urea level is increased by about at least 80%. In some embodiments, the urea level is increased by about at least 90%.

Urea levels in a subject or cell can be measured by any assay know in the art. For example, the blood urea nitrogen (BUN) is commonly used by health practitioners. In addition, commercially available colorimetric chemical assay kits that test urea levels in samples from multiple sources are available from Invitrogen (Blood Urea Nitrogen Assay Kit Cat #EIABUN), Abcam (Urea Assay Kit (ab83362)), Bio-Assays Systems (QuantiChrom™ Urea Assay Kit), and CellBioLabs (Urea Assay kit, STA-382). In addition, photometric assays that are processed by AutoAnalyzer machines can also be used to determine urea levels in samples. AutoAnalyzers are machines that can process and analyze samples using a flow technique called continuous flow analysis (CFA) or Segmented Flow Analysis (SFA). AutoAnalyzers are commercially available from a number of sources, including Beckman Coulter (Beckman Coulter AU analyzer), FIAlab Instruments, Inc (FIAlyzer-1000 and -2000), SEAL Analytical (AutoAnalyzer II/3 and QuAAtro CFA systems), Skalar Inc (SAN++ Continuous Flow Analyzers), and Astoria-Pacific International (Astoria Analyzer).

III. Compositions and Methods

Provided herein are compositions and methods for modulating the expression of one or more urea cycle-related genes to treat a urea cycle disorder. Any one or more of the compositions and methods described herein may be used to treat a urea cycle disorder in a subject.

The terms "subject" and "patient" are used interchangeably herein and refer to an animal to whom treatment with the compositions described herein is provided. In some embodiments, the subject is a mammal. In some embodiments, the subject is a human being.

In some embodiments, subjects may have been diagnosed with or have symptoms for a urea cycle disorder, e.g., CPS1 deficiency, OTC deficiency, ASS1 Deficiency, ASL deficiency, NAGS deficiency, ARG1 deficiency, ORNT1 deficiency, and/or citrin deficiency. In other embodiments, subjects may be susceptible to or at risk for a urea cycle disorder, e.g., CPS1 deficiency, OTC deficiency, ASS1 Deficiency, ASL deficiency, NAGS deficiency, ARG1 deficiency, ORNT1 deficiency, and/or citrin deficiency.

In some embodiments, subjects may carry mutations within or near a urea cycle-related gene. In some embodiments, subjects may carry one or more mutations within or near the CPS1 gene. In some embodiments, subjects may carry one or more mutations within or near the OTC gene. In some embodiments, subjects may carry one or more mutations within or near the ASS1 gene. In some embodiments, subjects may carry one or more mutations within or near the ASL gene. In some embodiments, subjects may carry one or more mutations within or near the NAGS gene. In some embodiments, subjects may carry one or more mutations within or near the ARG1 gene. In some embodiments, subjects may carry one or more mutations within or near the SLC25A15 gene. In some embodiments, subjects may carry one or more mutations within or near the SLC25A13 gene. In some embodiment, subjects may carry one functional allele and one mutated allele of a urea cycle-related gene. In some embodiment, subjects may carry two mutated alleles of a urea cycle-related gene.

In some embodiments, subjects may have dysregulated expression of at least one urea cycle-related gene. In some embodiments, subjects may have a deficiency of at least one urea cycle-related protein. In some embodiments, subjects may have at least one urea cycle-related protein that is partially functional.

In some embodiments, compositions and methods provided herein may be used to increase the expression of a urea cycle-related gene in a cell or a subject. Changes in gene expression may be assessed at the RNA level or protein level by various techniques known in the art and described herein, such as RNA-seq, qRT-PCR, Western Blot, or enzyme-linked immunosorbent assay (ELISA). Changes in gene expression may be determined by dividing the level of target gene expression in the treated cell or subject by the level of expression in an untreated or control cell or subject. In some embodiments, compositions and methods provided herein cause an increase in the expression of a urea cycle-related gene by at least about 10%, at least about 20%, at least about 30%, at least about 40%, at least about 50%, at least about 60%, at least about 70%, at least about 80%, at least about 90%, at least about 100%, at least about 125%, at least about 150%, at least about 175%, at least about 200%, at least about 250%, at least about 300%, at least about 400%, at least about 500%, from about 25% to about 50%, from about 40% to about 60%, from about 50% to about 70%, from about 60% to about 80%, from about 80% to about 100%, from about 100% to about 125%, from about 100 to about 150%, from about 150% to about 200%, from about 200% to about 300%, from about 300% to about 400%, from about 400% to about 500%, or more than 500%. In some embodiments, compositions and methods provided herein cause a fold change in the expression of a urea cycle-related gene by about 2 fold, about 3 fold, about 4 fold, about 5 fold, about 6 fold, about 7 fold, about 8 fold, about 9 fold, about 10 fold, about 12 fold, about 15 fold, about 18 fold, about 20 fold, about 25 fold, or more than 30 fold.

In some embodiments, the increase in the expression of a urea cycle-related gene induced by compositions and methods provided herein may be sufficient to prevent or alleviate one or more signs or symptoms of a urea cycle disorder.

Small Molecules

In some embodiments, compounds used to modulate the expression of a urea cycle-related gene may include small molecules. As used herein, the term "small molecule" refers a low molecular weight drug, i.e. <5000 Daltons organic compound that may help regulate a biological process. In some embodiments, small molecule compounds described herein are applied to a genomic system to interfere with components (e.g., transcription factor, signaling proteins) of the gene signaling networks associated with one or more urea cycle-related genes, thereby modulating the expression of these genes. In some embodiments, small molecule compounds described herein are applied to a genomic system to alter the boundaries of an insulated neighborhood and/or disrupt signaling centers associated with one or more urea cycle-related genes, thereby modulating the expression of these genes.

A small molecule screen may be performed to identify small molecules that act through signaling centers of an insulated neighborhood to alter gene signaling networks which may modulate expression of a select group of urea cycle-related genes. For example, known signaling agonists/antagonists may be administered. Credible hits are identified and validated by the small molecules that are known to work through a signaling center and modulate expression of the target gene.

In some embodiments, small molecule compounds capable of modulating expression of one or more urea cycle-related genes include, but are not limited to, EC144, upadacitinib, oclacitinib maleate, tofacitinib, BIIB021, 17-AAG (Tanespimycin), Afatinib, Amlodipine Besylate, Amuvatinib, AZD2858, BAY 87-2243, BIRB 796, bms-986094 (inx-189), Bosutinib, Calcitriol, CD 2665, Ceritinib, CI-4AS-1, CO-1686 (Rociletinib), CP-673451, Crenolanib, Crizotinib, Darapladib, Dasatinib, Deoxycorticosterone, Echinomycin, Enzastaurin, Epinephrine, Erlotinib, EVP-6124 (hydrochloride) (encenicline), EW-7197, FRAX597, GDC-0879, G06983, GSK2334470, GZD824 Dimesylate, INNO-206 (aldoxorubicin), LDN193189, LDN-212854, Merestinib, MK-0752, Momelotinib, Oligomycin A, OSU-03012, Pacritinib (SB1518), PHA-665752, Phenformin, Phorbol 12,13-dibutyrate, PND-1186, prednisone, R788 (fostamatinib disodium hexahydrate), Rifampicin, Semaxinib, SIS3, SKL2001, SMI-4a, T0901317, TFP, Thalidomide, Tivozanib, TP-434 (Eravacycline), WYE-125132 (WYE-132), and Zibotentan, or derivatives or analogs thereof. Any one of these compounds or a combination thereof may be administered to a subject to treat a urea cycle disorder, such as CPS1 deficiency, OTC deficiency, ASS1 Deficiency, ASL deficiency, NAGS deficiency, ARG1 deficiency, ORNT1 deficiency, and/or citrin deficiency.

In some embodiments, compounds capable of modulating the expression of one or more urea cycle-related genes may include 17-AAG (Tanespimycin), or a derivative or an analog thereof. 17-AAG (Tanespimycin), also known as NSC 330507 or CP 127374, is a potent HSP90 inhibitor with half-maximal inhibitory concentration ($IC_{50}$) of 5 nM, a 100-fold higher binding affinity for HSP90 derived from tumor cells than HSP90 from normal cells.

In some embodiments, compounds capable of modulating the expression of one or more urea cycle-related genes may include Afatinib, or a derivative or an analog thereof. Afatinib, also known as BIBW2992, irreversibly inhibits epidermal growth factor receptor (EGFR)/HER2 including EGFR (wildtype), EGFR (L858R), EGFR (L858R/T790M) and HER2 with $IC_{50}$ of 0.5 nM, 0.4 nM, 10 nM and 14 nM, respectively. It is 100-fold more active against Gefitinib-resistant L858R-T790M EGFR mutant.

In some embodiments, compounds capable of modulating the expression of one or more urea cycle-related genes may include Amlodipine Besylate, or a derivative or an analog thereof. Amlodipine, also known as Norvasc, is a long-acting calcium channel blocker with an $IC_{50}$ of 1.9 nM.

In some embodiments, compounds capable of modulating the expression of one or more urea cycle-related genes may include Amuvatinib, or a derivative or an analog thereof. Amuvatinib, also known as MP-470, is a potent and multi-targeted inhibitor of c-Kit, PDGFRα and FLT3 with $IC_{50}$ of 10 nM, 40 nM and 81 nM, respectively.

In some embodiments, compounds capable of modulating the expression of one or more urea cycle-related genes may include AZD2858, or a derivative or an analog thereof. AZD2858 is a selective GSK-3 inhibitor with an $IC_{50}$ of 68 nM. It activates Wnt signaling and increases bone mass in rats.

In some embodiments, compounds capable of modulating the expression of one or more urea cycle-related genes may include BAY 87-2243, or a derivative or an analog thereof. BAY 87-2243 is a potent and selective hypoxia-inducible factor-1 (HIF-1) inhibitor.

In some embodiments, compounds capable of modulating the expression of one or more urea cycle-related genes may include BIRB 796, or a derivative or an analog thereof. BIRB 796, also known as Doramapimod, is a highly selective p38α MAPK inhibitor with dissociation constant (Kd) of 0.1 nM, 330-fold greater selectivity versus JNK2. It shows weak inhibition for c-RAF, Fyn and Lck and insignificant inhibition of ERK-1, SYK, IKK2, ZAP-70, EGFR, HER2, PKA, PKC, and PKCα/β/γ.

In some embodiments, compounds capable of modulating the expression of one or more urea cycle-related genes may include bms-986094 (inx-189), or a derivative or an analog thereof. Bms-986094, also known as INX-08189, INX-189, or IDX-189, is a prodrug of a guanosine nucleotide analogue (2'-C-methylguanosine). Bms-986094 is an RNA-directed RNA polymerase (NS5B) inhibitor originally developed by Inhibitex (acquired by Bristol-Myers Squibb in 2012). It was in phase II clinical trials for the treatment of hepatitis C virus infection. However, the study was discontinued due to unexpected cardiac and renal adverse events.

In some embodiments, compounds capable of modulating the expression of one or more urea cycle-related genes may include Bosutinib, or a derivative or an analog thereof. Bosutinib, also known as SKI-606, is a novel, dual Src/Abl inhibitor with $IC_{50}$ of 1.2 nM and 1 nM, respectively.

In some embodiments, compounds capable of modulating the expression of one or more urea cycle-related genes may include Calcitriol, or a derivative or an analog thereof. Calcitriol, also known as 1,25-Dihydroxyvitamin D3 or Rocaltrol, is the hormonally active form of vitamin D, Calcitriol is the active metabolite of vitamin D3 that activates the vitamin D receptor.

In some embodiments, compounds capable of modulating the expression of one or more urea cycle-related genes may include CD 2665, or a derivative or an analog thereof. CD 2665 is a selective RARβγ antagonist with Kd values of 110 nM, 306 nM, and >1000 nM for RARγ, RARβ, and RARα, respectively. It blocks retinoic acid-induced apoptosis ex vivo.

In some embodiments, compounds capable of modulating the expression of one or more urea cycle-related genes may include Ceritinib, or a derivative or an analog thereof. Ceritinib, also known as LDK378, is potent inhibitor against ALK with $IC_{50}$ of 0.2 nM, exhibiting 40- and 35-fold selectivity against IGF-1R and InsR, respectively.

In some embodiments, compounds capable of modulating the expression of one or more urea cycle-related genes may include CI-4AS-1, or a derivative or an analog thereof. CI-4AS-1 is a potent steroidal androgen receptor agonist ($IC_{50}$=12 nM). It mimics the action of 5α-dihydrotestosterone (DHT). It transactivates the mouse mammary tumor virus (MMTV) promoter; represses MMP1 promoter activity. It also inhibits 5α-reductase type I and II with $IC_{50}$ values of 6 nM and 10 nM, respectively.

In some embodiments, compounds capable of modulating the expression of one or more urea cycle-related genes may include CO-1686 (Rociletinib), or a derivative or an analog thereof. CO-1686, also known as Rociletinib, is a novel, irreversible and orally delivered kinase inhibitor that specifically targets the mutant forms of EGFR including T790M ($IC_{50}$=21 nM).

In some embodiments, compounds capable of modulating the expression of one or more urea cycle-related genes may include CP-673451, or a derivative or an analog thereof. CP 673451 is a selective inhibitor of PDGFRα/β with $IC_{50}$ of 10 nM/1 nM, exhibiting >450-fold selectivity over other angiogenic receptors. CP 673451 also has antiangiogenic and antitumor activity.

In some embodiments, compounds capable of modulating the expression of one or more urea cycle-related genes may include Crenolanib, or a derivative or an analog thereof. Crenolanib, also known as CP-868596, is a potent and selective inhibitor of PDGFRα/β with Kd of 2.1 nM/3.2 nM. It also potently inhibits FLT3 and is sensitive to D842V mutation not V561D mutation. It is >100-fold more selective for PDGFR than c-Kit, VEGFR-2, TIE-2, FGFR-2, EGFR, erbB2, and Src.

In some embodiments, compounds capable of modulating the expression of one or more urea cycle-related genes may include Crizotinib, or a derivative or an analog thereof. Crizotinib, also known as PF-2341066, is a potent inhibitor of c-Met and ALK with $IC_{50}$ of 11 nM and 24 nM, respectively.

In some embodiments, compounds capable of modulating the expression of one or more urea cycle-related genes may include Darapladib, or a derivative or an analog thereof. Darapladib is a selective and orally active inhibitor of lipoprotein-associated phospholipase A2 (Lp-PLA2) with $IC_{50}$ of 270 pM. Lp-PLA2 may link lipid metabolism with inflammation, leading to the increased stability of atherosclerotic plaques present in the major arteries. Darapladib is being studied as a possible add-on treatment for atherosclerosis.

In some embodiments, compounds capable of modulating the expression of one or more urea cycle-related genes may include Dasatinib, or a derivative or an analog thereof. Dasatinib is a novel, potent and multi-targeted inhibitor that targets Abl, Src, and c-Kit, with IC50 of <1 nM, 0.8 nM, and 79 nM, respectively.

In some embodiments, compounds capable of modulating the expression of one or more urea cycle-related genes may include Deoxycorticosterone, or a derivative or an analog thereof. Deoxycorticosterone acetate is a steroid hormone used for intramuscular injection for replacement therapy of the adrenocortical steroid. 11β-hydroxylation of deoxycorticosterone leads to corticosterone.

In some embodiments, compounds capable of modulating the expression of one or more urea cycle-related genes may include Echinomycin, or a derivative or an analog thereof. Hypoxia-inducible factor-1 (HIF-1) is a transcription factor that controls genes involved in glycolysis, angiogenesis, migration, and invasion. Echinomycin is a cell-permeable inhibitor of HIF-1-mediated gene transcription. It acts by intercalating into DNA in a sequence-specific manner, blocking the binding of either HIF-1a or HIF-10 to the hypoxia-responsive element. Echinomycin reversibly inhibits hypoxia-induced HIF-1 transcription activity in U215 cells with a half maximal effective concentration ($EC_{50}$) value of 1.2 nM. It inhibits hypoxia-induced expression of vascular endothelial growth factor, blocking angiogenesis and altering excitatory synaptic transmission in hippocampal neurons. Echinomycin also impairs expression of survivin, enhancing the sensitivity of multiple myeloma cells to melphalan.

In some embodiments, compounds capable of modulating the expression of one or more urea cycle-related genes may include Enzastaurin, or a derivative or an analog thereof. Enzastaurin, also known as LY317615, is a potent PKCβ selective inhibitor with $IC_{50}$ of 6 nM, exhibiting 6- to 20-fold selectivity against PKCα, PKCγ and PKCε.

In some embodiments, compounds capable of modulating the expression of one or more urea cycle-related genes may include Epinephrine, or a derivative or an analog thereof. Epinephrine HCl is a hormone and a neurotransmitter.

In some embodiments, compounds capable of modulating the expression of one or more urea cycle-related genes may include Erlotinib, or a derivative or an analog thereof. Erlotinib is an EGFR inhibitor with $IC_{50}$ of 2 nM, >1000-fold more sensitive for EGFR than human c-Src or v-Abl.

In some embodiments, compounds capable of modulating the expression of one or more urea cycle-related genes may include EVP-6124 (hydrochloride) (encenicline), or a derivative or an analog thereof. EVP-6124 hydrochloride, also known as encenicline, is a novel partial agonist of α7 neuronal nicotinic acetylcholine receptors (nAChRs). EVP-6124 shows selectivity for α7 nAChRs and does not activate or inhibit heteromeric α4β2 nAChRs.

In some embodiments, compounds capable of modulating the expression of one or more urea cycle-related genes may include EW-7197. EW-7197 is a highly potent, selective, and orally bioavailable TGF-β receptor ALK4/ALK5 inhibitor with $IC_{50}$ of 13 nM and 11 nM, respectively.

In some embodiments, compounds capable of modulating the expression of one or more urea cycle-related genes may include FRAX597, or a derivative or an analog thereof. FRAX597 is a potent, ATP-competitive inhibitor of group I PAKs with $IC_{50}$ of 8 nM, 13 nM, and 19 nM for PAK1, PAK2, and PAK3, respectively.

In some embodiments, compounds capable of modulating the expression of one or more urea cycle-related genes may include GDC-0879, or a derivative or an analog thereof. GDC-0879 is a novel, potent, and selective B-Raf inhibitor with $IC_{50}$ of 0.13 nM with activity against c-Raf as well.

In some embodiments, compounds capable of modulating the expression of one or more urea cycle-related genes may include G06983, or a derivative or an analog thereof. G06983 is a pan-PKC inhibitor against for PKCα, PKCβ, PKCγ and PKCδ with $IC_{50}$ of 7 nM, 7 nM, 6 nM and 10 nM, respectively. It is less potent to PKCζ and inactive to PKCμ.

In some embodiments, compounds capable of modulating the expression of one or more urea cycle-related genes may include GSK2334470, or a derivative or an analog thereof. GSK2334470 is a novel PDK1 inhibitor with $IC_{50}$ of about 10 nM and with no activity at other close related AGC-kinases.

In some embodiments, compounds capable of modulating the expression of one or more urea cycle-related genes may include GZD824 Dimesylate, or a derivative or an analog thereof. GZD824 is a novel orally bioavailable Bcr-Abl inhibitor for Bcr-Abl (wildtype) and Bcr-Abl (T315I) with $IC_{50}$ of 0.34 nM and 0.68 nM, respectively.

In some embodiments, compounds capable of modulating the expression of one or more urea cycle-related genes may include INNO-206 (aldoxorubicin), or a derivative or an analog thereof. INNO-206, also known as Aldoxorubicin, is the 6-maleimidocaproyl hydrazone derivative prodrug of the anthracycline antibiotic doxorubicin (DOXO-EMCH) with antineoplastic activity.

In some embodiments, compounds capable of modulating the expression of one or more urea cycle-related genes may include LDN193189, or a derivative or an analog thereof. LDN193189 is a selective BMP signaling inhibitor that inhibits the transcriptional activity of the BMP type I receptors ALK2 and ALK3 with $IC_{50}$ of 5 nM and 30 nM, respectively, exhibiting 200-fold selectivity for BMP versus TGF-B.

In some embodiments, compounds capable of modulating the expression of one or more urea cycle-related genes may include LDN-212854, or a derivative or an analog thereof. LDN-212854 is a potent and selective BMP receptor inhibitor with $IC_{50}$ of 1.3 nM for ALK2, exhibiting about 2-, 66-, 1641-, and 7135-fold selectivity over ALK1, ALK3, ALK4, and ALK5, respectively.

In some embodiments, compounds capable of modulating the expression of one or more urea cycle-related genes may include Merestinib, or a derivative or an analog thereof. Merestinib, also known as LY2801653, is a type-II ATP competitive, slow-off inhibitor of MET tyrosine kinase with a Kd of 2 nM, a pharmacodynamic residence time (Koff) of 0.00132 $min^{-1}$ and half life ($t_{1/2}$) of 525 min.

In some embodiments, compounds capable of modulating the expression of one or more urea cycle-related genes may include MK-0752, or a derivative or an analog thereof. MK-0752 is a potent, reversible inhibitor of γ-secretase, reducing the cleavage of amyloid precursor protein (APP) to Aβ40 in human neuroblastoma SH-SYSY cells with an $IC_{50}$ value of 5 nM. It is orally bioavailable and crosses the blood-brain barrier, as orally administered MK-0752 dose-dependently reduces the generation of new amyloid β protein in the brain of rhesus monkeys. Through its effects on the NOTCH pathway, MK-0752 reduces the number of breast cancer stem cells in tumor grafts, enhancing the efficacy of the chemotherapy drug docetaxel in mice with breast cancer tumors.

In some embodiments, compounds capable of modulating the expression of one or more urea cycle-related genes may include Momelotinib, or a derivative or an analog thereof. Momelotinib, also known as CYT387, is an ATP-competitive inhibitor of JAK1/JAK2 with $IC_{50}$ of 11 nM/18 nM and approximately 10-fold selectivity versus JAK3.

In some embodiments, compounds capable of modulating the expression of one or more urea cycle-related genes may include Oligomycin A, or a derivative or an analog thereof. Oligomycin A is an inhibitor of ATP synthase, inhibits oxidative phosphorylation and all the ATP-dependent processes occurring on the coupling membrane of mitochondria.

In some embodiments, compounds capable of modulating the expression of one or more urea cycle-related genes may include OSU-03012, or a derivative or an analog thereof. OSU-03012 is a potent inhibitor of recombinant PDK-1 with $IC_{50}$ of 5 μM and 2-fold increase in potency over OSU-02067.

In some embodiments, compounds capable of modulating the expression of one or more urea cycle-related genes may include Pacritinib (SB1518), or a derivative or an analog thereof. Pacritinib, also known as SB1518, is a potent and selective inhibitor JAK2 and FLT3 with $IC_{50}$s of 23 and 22 nM in cell-free assays, respectively.

In some embodiments, compounds capable of modulating the expression of one or more urea cycle-related genes may include PHA-665752, or a derivative or an analog thereof. PHA-665752 is a potent, selective and ATP-competitive c-Met inhibitor with IC50 of 9 nM, >50-fold selectivity for c-Met than RTKs or STKs.

In some embodiments, compounds capable of modulating the expression of one or more urea cycle-related genes may include Phenformin, or a derivative or an analog thereof. Phenformin hydrochloride is a hydrochloride salt of phenformin that is an anti-diabetic drug from the biguanide class.

In some embodiments, compounds capable of modulating the expression of one or more urea cycle-related genes may include Phorbol 12,13-dibutyrate, or a derivative or an analog thereof. Phorbol 12,13-dibutyrate is a protein kinase C activator. It induces contraction of vascular smooth muscle and inhibits MLC phosphatase (MLCP) in vascular smooth muscle. The activity does not alter intracellular $Ca^{2+}$ concentration. It also inhibits the activity of Na+, K+ ATPase in opossum kidney cells.

In some embodiments, compounds capable of modulating the expression of one or more urea cycle-related genes may include Pifithrin-µ, or a derivative or an analog thereof. Pifithrin-µ, specifically inhibits p53 activity by reducing its affinity to Bcl-xL and Bcl-2, and it also inhibits HSP70 function and autophagy.

In some embodiments, compounds capable of modulating the expression of one or more urea cycle-related genes may include PND-1186, or a derivative or an analog thereof. PND-1186, VS-4718, is a reversible and selective focal adhesion kinase (FAK) inhibitor with $IC_{50}$ of 1.5 nM.

In some embodiments, compounds capable of modulating the expression of one or more urea cycle-related genes may include prednisone, or a derivative or an analog thereof. Prednisone is a synthetic glucocorticoid with anti-inflammatory and immunosuppressive activity.

In some embodiments, compounds capable of modulating the expression of one or more urea cycle-related genes may include R788 (fostamatinib disodium hexahydrate), or a derivative or an analog thereof. R788 sodium salt hydrate (fostamatinib), a prodrug of the active metabolite R406, is a potent Syk inhibitor with $IC_{50}$ of 41 nM.

In some embodiments, compounds capable of modulating the expression of one or more urea cycle-related genes may include Rifampicin, or a derivative or an analog thereof. Rifampicin is a member of the rifamycin class of antibiotics, as it inhibits bacterial DNA-dependent RNA synthesis (Ki=~1 nM). While this compound does not directly affect RNA synthesis in humans, its use as an antibiotic is limited by its potency toward activation of the pregnane X receptor (PXR, $EC_{50}$=~2 µM), which results in the up-regulation of enzymes that alter drug metabolism. Access of rifampicin to the nuclear receptor PXR requires its import into the cell via organic anion transporters (OATs) in the OAT polypeptide (OATP) family. By acting as a transporter substrate, rifampicin inhibits OATPs with Ki/$IC_{50}$ values ranging from 0.58-18 µM.

In some embodiments, compounds capable of modulating the expression of one or more urea cycle-related genes may include Semaxanib, or a derivative or an analog thereof. Semaxanib is a quinolone derivative with potential antineoplastic activity. Semaxanib reversibly inhibits ATP binding to the tyrosine kinase domain of vascular endothelial growth factor receptor 2 (VEGFR2).

In some embodiments, compounds capable of modulating the expression of one or more urea cycle-related genes may include SIS3, or a derivative or an analog thereof. SIS3 is a specific inhibitor of Smad3. It inhibits TGF-B and activin signaling by suppressing Smad3 phosphorylation without affecting the MAPK/p38, ERK, or PI3-kinase signaling pathways.

In some embodiments, compounds capable of modulating the expression of one or more urea cycle-related genes may include SKL2001, or a derivative or an analog thereof. SKL2001 is a novel agonist of the Wnt/β-catenin pathway that disrupts the Axin/β-catenin interaction.

In some embodiments, compounds capable of modulating the expression of one or more urea cycle-related genes may include SMI-4a, or a derivative or an analog thereof. SMI-4a is a potent inhibitor of Pim1 with $IC_{50}$ of 17 nM, with modest potency to Pim-2. It does not significantly inhibit other serine/threonine- or tyrosine-kinases.

In some embodiments, compounds capable of modulating the expression of one or more urea cycle-related genes may include T0901317, or a derivative or an analog thereof. T0901317 is a potent, non-selective LXR agonist with $EC_{50}$ of 50 nM. It increases ABCA1 expression associated with cholesterol efflux regulation and HDL metabolism. It also increases muscle expression of PPAR-δ and shows antiobesogenic effects in vivo.

In some embodiments, compounds capable of modulating the expression of one or more urea cycle-related genes may include TFP, or a derivative or an analog thereof. Trifluoperazine (TFP) has central antiadrenergic, antidopaminergic, and minimal anticholinergic effects. It is thought to function by blockading dopamine D1 and D2 receptors in the mesocortical and mesolimbic pathways, relieving or minimizing such symptoms of schizophrenia as hallucinations, delusions, and disorganized thought and speech.

In some embodiments, compounds capable of modulating the expression of one or more urea cycle-related genes may include Thalidomide, or a derivative or an analog thereof. Thalidomide was introduced as a sedative drug, immunomodulatory agent and also is investigated for treating symptoms of many cancers. Thalidomide inhibits an E3 ubiquitin ligase, which is a CRBN-DDB1-Cul4A complex.

In some embodiments, compounds capable of modulating the expression of one or more urea cycle-related genes may include Tivozanib, or a derivative or an analog thereof. Tivozanib, also known as AV-951, is a potent and selective VEGFR inhibitor for VEGFR1/2/3 with $IC_{50}$ of 30 nM/6.5 nM/15 nM. It also inhibits PDGFR and c-Kit but exhibits low activity against FGFR-1, Flt3, c-Met, EGFR and IGF-1R.

In some embodiments, compounds capable of modulating the expression of one or more urea cycle-related genes may include TP-434 (Eravacycline), or a derivative or an analog thereof. TP-434, also known as Eravacycline, is a novel, broad-spectrum fluorocycline antibiotic with activity against bacteria expressing major antibiotic resistance mechanisms including tetracycline-specific efflux and ribosomal-protection.

In some embodiments, compounds capable of modulating the expression of one or more urea cycle-related genes may include WYE-125132 (WYE-132), or a derivative or an analog thereof. WYE-125132, also known as WYE-132, is a highly potent, ATP-competitive mTOR inhibitor with $IC_{50}$ of 0.19 nM. It is highly selective for mTOR versus PI3Ks or PI3K-related kinases hSMG1 and ATR.

In some embodiments, compounds capable of modulating the expression of one or more urea cycle-related genes may include Zibotentan, or a derivative or an analog thereof. Zibotentan, also known as ZD4054, is an orally administered, potent and specific endothelin A receptor (ETA)-receptor antagonist with $IC_{50}$ of 21 nM.

In some embodiments, compounds capable of modulating the expression of one or more urea cycle-related genes may include Mubritinib (TAK 165), or a derivative or an analog thereof. Mubritinib is a selective inhibitor of the human epidermal growth factor receptor 2 (HER2).

In some embodiments, compounds capable of modulating the expression of one or more urea cycle-related genes may include Dasatinib, or a derivative or an analog thereof. Dasatinib is a potent inhibitor of the non-receptor tyrosine kinases Abl, Src, and Lck.

In some embodiments, compounds capable of modulating the expression of one or more urea cycle-related genes may include PF-00562271, or a derivative or an analog thereof. PF-00562271 is a potent, ATP-competitive, reversible inhibitor of focal adhesion kinase (FAK).

In some embodiments, compounds capable of modulating the expression of one or more urea cycle-related genes may include Lifirafenib (BGB-283), or a derivative or an analog thereof. Lifirafenib (BGB-283) is a potent inhibitor of the RAF family kinases and EGFR.

In some embodiments, compounds capable of modulating the expression of one or more urea cycle-related genes may include BMS-214662, or a derivative or an analog thereof. BMS-214662 is a farnesyltransferase inhibitor, which results in inhibition of Ras function.

In some embodiments, compounds capable of modulating the expression of one or more urea cycle-related genes may include Crenolanib, or a derivative or an analog thereof. Crenolanib is a potent inhibitor of class III receptor tyrosine kinases (RTK) FLT3 (FMS-like Tyrosine Kinase 3), PDGFR α (Platelet-Derived Growth Factor Receptor), and PDGFR β.

In some embodiments, compounds capable of modulating the expression of one or more urea cycle-related genes may include XL228, or a derivative or an analog thereof. XL228 inhibits the insulin-like growth factor type-1 receptor (IGF1R), Src and Abl tyrosine kinases, as well as Aurora A.

In some embodiments, compounds capable of modulating the expression of one or more urea cycle-related genes may include Echinomycin, or a derivative or an analog thereof. Echinomycin reversibly inhibits Hypoxia-inducible factor-1 (HIF-1) transcription activity.

Polypeptides

In some embodiments, compounds for altering expression of a urea cycle-related gene comprise a polypeptide. As used herein, the term "polypeptide" refers to a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analog of a corresponding naturally occurring amino acid.

In some embodiments, polypeptide compounds capable of modulating expression of one or more urea cycle-related genes include, but are not limited to, Activin, Anti mullerian hormone, BMP2, EGF, FGF, GDF10 (BMP3b), GDF2 (BMP9), HGF/SF, IGF-1, Nodal, PDGF, TNF-α, and Wnt3a, or derivatives or analogs thereof. Any one of these compounds or a combination thereof may be administered to a subject to treat a urea cycle disorder, such as CPS1 deficiency, OTC deficiency, ASS1 Deficiency, ASL deficiency, NAGS deficiency, ARG1 deficiency, ORNT1 deficiency, and/or citrin deficiency.

In some embodiments, compounds capable of modulating the expression of one or more urea cycle-related genes may include Activin, or a derivative or an analog thereof. Activins are homodimers or heterodimers of the different β subunit isoforms, part of the transforming growth factor-beta (TGF-B) family. Mature Activin A has two 116 amino acids residues PA subunits (PA-βA). Activin displays an extensive variety of biological activities, including mesoderm induction, neural cell differentiation, bone remodeling, hematopoiesis, and reproductive physiology. Activins takes part in the production and regulation of hormones such as FSH, LH, GnRH and ACTH. Cells that are identified to express Activin A include fibroblasts, endothelial cells, hepatocytes, vascular smooth muscle cells, macrophages, keratinocytes, osteoclasts, bone marrow monocytes, prostatic epithelium, neurons, chondrocytes, osteoblasts, Leydig cells, Sertoli cells, and ovarian granulosa cells.

In some embodiments, compounds capable of modulating the expression of one or more urea cycle-related genes may include anti Mullerian hormone, or a derivative or an analog thereof. Anti Mullerian hormone is a member of the TGF-B gene family which mediates male sexual differentiation. Anti Mullerian hormone causes the regression of Mullerian ducts which would otherwise differentiate into the uterus and fallopian tubes. Some mutations in the anti-Mullerian hormone result in persistent Mullerian duct syndrome.

In some embodiments, compounds capable of modulating the expression of one or more urea cycle-related genes may include BMP2, or a derivative or an analog thereof. Bone morphogenetic protein 2 (BMP2) belongs to the TGF-B superfamily. The BMP family members are regulators of cell growth and differentiation in both embryonic and adult tissues. BMP2 is a candidate gene for the autosomal dominant disease of fibrodysplasia (myositis) ossificans progressiva.

In some embodiments, compounds capable of modulating the expression of one or more urea cycle-related genes may include EGF, or a derivative or an analog thereof. Epidermal Growth Factor (EGF) is a polypeptide growth factor which stimulates the proliferation of a wide range of epidermal and epithelial cells.

In some embodiments, compounds capable of modulating the expression of one or more urea cycle-related genes may include FGF, or a derivative or an analog thereof. Fibroblast Growth Factor-acidic (FGF-acidic), also known as FGF-1 and endothelial cell growth factor, is a member of the FGF family which currently contain 23 members. FGF acidic and basic, unlike the other members of the family, lack signal peptides and are apparently secreted by mechanisms other than the classical protein secretion pathway. FGF acidic has been detected in large amounts in the brain. Other cells known to express FGF acidic include hepatocytes, vascular smooth muscle cells, CNS neurons, skeletal muscle cells, fibroblasts, keratinocytes, endothelial cells, intestinal columnar epithelium cells and pituitary basophils and acidophilus.

In some embodiments, compounds capable of modulating the expression of one or more urea cycle-related genes may include GDF10 (BMP3b), or a derivative or an analog thereof. GDF10, also known as BMP3b, is a member of the BMP family and the TGF-B superfamily. GDF10 is expressed in femur, brain, lung, skeletal, muscle, pancreas and testis, and has a role in head formation and possibly multiple roles in skeletal morphogenesis. In humans, GDF10 mRNA is found in the cochlea and lung of fetuses, and in testis, retina, pineal gland, and other neural tissues of adults. These proteins are characterized by a polybasic proteolytic processing site which is cleaved to produce a mature protein containing 7 conserved cysteine residues.

In some embodiments, compounds capable of modulating the expression of one or more urea cycle-related genes may include GDF2 (BMP9), or a derivative or an analog thereof. GDF2, also known as BMP9, is a member of BMP family and the TGF-B superfamily. BMP9 has a role in the maturation of basal forebrain cholinergic neurons (BFCN) as well as the induction and maintenance of the ability of these cells to respond to acetylcholine. BFCN are important for the processes of learning, memory and attention. BMP9 is a potent inducer of hepcidin (a cationic peptide that has an antimicrobial properties) in hepatocytes and can regulate iron metabolism. The physiological receptor of BMP9 is thought to be activin receptor-like kinase 1, ALK1 (also known as ACVRL1), an endothelial-specific type I receptor of the TGF-B receptor family. BMP9 is one of the most potent BMPs to induce orthotopic bone formation in vivo. BMP3, a blocker of most BMPs appears not to affect BMP9.

In some embodiments, compounds capable of modulating the expression of one or more urea cycle-related genes may include HGF/SF, or a derivative or an analog thereof. Hepatocyte Growth Factor (HGF), also known as hepatopoietin-A and scatter factor (SF), is a pleiotropic mitogen belonging to the peptidase Si family (plasminogen subfamily). It is produced by mesenchymal cells and acts on epithelial cells, endothelial cells and hematopoietic progenitor cells. HGF binds to the proto-oncogenic c-Met receptor to activate a tyrosine kinase signaling cascade. It regulates cell growth, motility and morphogenesis, and it also plays a pivotal role in angiogenesis, tumorigenesis and tissue regeneration.

In some embodiments, compounds capable of modulating the expression of one or more urea cycle-related genes may include IGF-1, or a derivative or an analog thereof. Insulin-like growth factor I (IGF-I) also known as Somatamedin C is a hormone similar in molecular structure to insulin. Human IGF-I has two isoforms (IGF-IA and IGF-IB) which is differentially expressed by various tissues. Mature human IGF-I respectively shares 94% and 96% aa sequence identity with mouse and rat IGF-I. Both IGF-I and IGF-II (another ligand of IGF) can signal through the IGF-I receptor (IGFIR), but IGF-II can alone bind the IGF-II receptor (IGFIIR/Mannose-6-phosphate receptor). IGF-I plays an important role in childhood growth and continues to have anabolic effects in adults.

In some embodiments, compounds capable of modulating the expression of one or more urea cycle-related genes may include Nodal, or a derivative or an analog thereof. Nodal is a 13 kDa member of the TGF-B superfamily of molecules. In human, it is synthesized as a 347 amino acid preprecursor that contains a 26 amino acid signal sequence, a 211 amino acid prodomain, and a 110 amino acid mature region. Consistent with its TGF-B superfamily membership, it exists as a disulfide-linked homodimer and would be expected to demonstrate a cysteine-knot motif. Mature human Nodal is 99%, 98%, 96% and 98% amino acid identical to mature canine, rat, bovine and mouse Nodal, respectively. Nodal signals through two receptor complexes, both of which contain members of the TGF-beta family of Ser/Thr kinase receptors.

In some embodiments, compounds capable of modulating the expression of one or more urea cycle-related genes may include PDGF, or a derivative or an analog thereof. the Platelet-derived growth factor (PDGF) is a disulfide-linked dimer consisting of two peptides-chain A and chain B. PDGF has three subforms: PDGF-AA, PDGF-BB, PDGF-AB. It is involved in a number of biological processes, including hyperplasia, embryonic neuron development, chemotaxis, and respiratory tubule epithelial cell development. The function of PDGF is mediated by two receptors (PDGFRα and PDGFRβ).

In some embodiments, compounds capable of modulating the expression of one or more urea cycle-related genes may include TNF-α, or a derivative or an analog thereof. TNF-α, the prototypical member of the TNF protein superfamily, is a homotrimeric type-II membrane protein. Membrane bound TNF-α is cleaved by the metalloprotease TACE/ADAM17 to generate a soluble homotrimer. Both membrane and soluble forms of TNF-α are biologically active. TNF-α is produced by a variety of immune cells including T cells, B cells, NK cells and macrophages. Cellular response to TNF-α is mediated through interaction with receptors TNF-R1 and TNF-R2 and results in activation of pathways that favor both cell survival and apoptosis depending on the cell type and biological context. Activation of kinase pathways (including JNK, ERK (p44/42), p38 MAPK and NF-kB) promotes the survival of cells, while TNF-α mediated activation of caspase-8 leads to programmed cell death. TNF-α plays a key regulatory role in inflammation and host defense against bacterial infection, notably *Mycobacterium tuberculosis*. The role of TNF-α in autoimmunity is underscored by blocking TNF-α action to treat rheumatoid arthritis and Crohn's disease.

In some embodiments, compounds capable of modulating the expression of one or more urea cycle-related genes may include Wnt3a, or a derivative or an analog thereof. The WNT gene family consists of structurally related genes which encode secreted signaling proteins. These proteins have been implicated in oncogenesis and in several developmental processes, including regulation of cell fate and patterning during embryogenesis. This gene is a member of the WNT gene family. It encodes a protein which shows 96% amino acid identity to mouse Wnt3a protein, and 84% to human WNT3 protein, another WNT gene product. This gene is clustered with WNT14 gene, another family member, in chromosome 1q42 region.

Antibodies

In some embodiments, compounds for altering expression of one or more urea cycle-related genes comprise an antibody. In one embodiment, antibodies provided herein comprising antibodies, antibody fragments, their variants or derivatives described herein are specifically immunoreactive with at least one component of the gene signaling networks associated with the urea cycle-related gene.

As used herein, the term "antibody" is used in the broadest sense and specifically covers various embodiments including, but not limited to monoclonal antibodies, polyclonal antibodies, multispecific antibodies (e.g. bispecific antibodies formed from at least two intact antibodies), and antibody fragments such as diabodies so long as they exhibit a desired biological activity. Antibodies are primarily amino-acid based molecules but may also comprise one or more modifications such as with sugar moieties.

"Antibody fragments" comprise a portion of an intact antibody, preferably comprising an antigen binding region thereof. Examples of antibody fragments include Fab, Fab', F(ab')2, and Fv fragments; diabodies; linear antibodies; single-chain antibody molecules; and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of crosslinking antigen.

Antibodies provided herein may comprise one or more of these fragments. For the purposes herein, an "antibody" may comprise a heavy and light variable domain as well as an Fc region.

"Native antibodies" are usually heterotetrameric glycoproteins of about 150,000 Daltons, composed of two identical light (L) chains and two identical heavy (H) chains. Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains that differ extensively in sequence among antibodies and are used in the binding and specificity of each particular antibody for its particular antigen. As used herein, the term "Fv" refers to antibody fragments which contain a complete antigen-recognition and antigen-binding site. This region consists of a dimer of one heavy chain and one light chain variable domain in tight, non-covalent association.

Antibody "light chains" from any vertebrate species can be assigned to one of two clearly distinct types, called kappa and lambda based on amino acid sequences of their constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

"Single-chain Fv" or "scFv" as used herein, refers to a fusion protein of VH and VL antibody domains, wherein these domains are linked together into a single polypeptide chain. In some embodiments, the Fv polypeptide linker enables the scFv to form the desired structure for antigen binding.

The term "diabodies" refers to small antibody fragments with two antigen-binding sites, which fragments comprise a heavy chain variable domain $V_H$ connected to a light chain variable domain $V_L$ in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90:6444-6448 (1993), the contents of each of which are incorporated herein by reference in their entirety.

Antibodies provided herein may be polyclonal or monoclonal or recombinant, produced by methods known in the art or as described in this application. The term "monoclonal antibody" as used herein refers to an antibody obtained from a population of substantially homogeneous cells (or clones), i.e., the individual antibodies comprising the population are identical and/or bind the same epitope, except for possible variants that may arise during production of the monoclonal antibody, such variants generally being present in minor amounts. In contrast to polyclonal antibody preparations that typically include different antibodies directed against different determinants (epitopes), each monoclonal antibody is directed against a single determinant on the antigen.

The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

"Humanized" forms of non-human (e.g., murine) antibodies are chimeric antibodies that contain minimal sequence derived from non-human immunoglobulin. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and capacity.

The term "hypervariable region" when used herein in reference to antibodies refers to regions within the antigen binding domain of an antibody comprising the amino acid residues that are responsible for antigen binding. The amino acids present within the hypervariable regions determine the structure of the complementarity determining region (CDR). As used herein, the "CDR" refers to the region of an antibody that comprises a structure that is complimentary to its target antigen or epitope.

In some embodiments, the compositions provided herein may be antibody mimetics. The term "antibody mimetic" refers to any molecule which mimics the function or effect of an antibody and which binds specifically and with high affinity to their molecular targets. As such, antibody mimics include nanobodies and the like.

In some embodiments, antibody mimetics may be those known in the art including, but are not limited to affibody molecules, affilins, affitins, anticalins, avimers, DARPins, Fynomers and Kunitz and domain peptides. In other embodiments, antibody mimetics may include one or more non-peptide region.

As used herein, the term "antibody variant" refers to a biomolecule resembling an antibody in structure and/or function comprising some differences in their amino acid sequence, composition or structure as compared to a native antibody.

The preparation of antibodies, whether monoclonal or polyclonal, is known in the art. Techniques for the production of antibodies are well known in the art and described, e.g. in Harlow and Lane "Antibodies, A Laboratory Manual," Cold Spring Harbor Laboratory Press, 1988 and Harlow and Lane "Using Antibodies: A Laboratory Manual" Cold Spring Harbor Laboratory Press, 1999.

Antibodies provided herein may be characterized by their target molecule(s), by the antigens used to generate them, by their function (whether as agonists or antagonists) and/or by the cell niche in which they function.

Measures of antibody function may be made relative to a standard under normal physiologic conditions, in vitro or in vivo. Measurements may also be made relative to the presence or absence of the antibodies. Such methods of measuring include standard measurement in tissue or fluids such as serum or blood such as Western blot, enzyme-linked immunosorbent assay (ELISA), activity assays, reporter assays, luciferase assays, polymerase chain reaction (PCR) arrays, gene arrays, Real Time reverse transcriptase (RT) PCR and the like.

Antibodies provided herein exert their effects via binding (reversibly or irreversibly) to one or more target sites. While not wishing to be bound by theory, target sites which represent a binding site for an antibody, are most often formed by proteins or protein domains or regions. However, target sites may also include biomolecules such as sugars, lipids, nucleic acid molecules or any other form of binding epitope.

Alternatively, or additionally, antibodies provided herein may function as ligand mimetics or nontraditional payload carriers, acting to deliver or ferry bound or conjugated drug payloads to specific target sites.

Changes elicited by antibodies provided herein may result in a neomorphic change in the cell. As used herein, "a neomorphic change" is a change or alteration that is new or different. Such changes include extracellular, intracellular and cross cellular signaling.

In some embodiments, compounds or agents provided herein act to alter or control proteolytic events. Such events may be intracellular or extracellular.

Antibodies provided herein, as well as antigens used to generate them, are primarily amino acid-based molecules. These molecules may be "peptides," "polypeptides," or "proteins."

As used herein, the term "peptide" refers to an amino-acid based molecule having from 2 to 50 or more amino acids. Special designators apply to the smaller peptides with "dipeptide" referring to a two amino acid molecule and "tripeptide" referring to a three amino acid molecule. Amino acid based molecules having more than 50 contiguous amino acids are considered polypeptides or proteins.

The terms "amino acid" and "amino acids" refer to all naturally occurring L-alpha-amino acids as well as non-naturally occurring amino acids. Amino acids are identified by either the one-letter or three-letter designations as follows: aspartic acid (Asp:D), isoleucine threonine (Thr:T), leucine (Leu:L), serine (Ser:S), tyrosine (Tyr:Y), glutamic acid (Glu:E), phenylalanine (Phe:F), proline (Pro:P), histidine (His:H), glycine (Gly:G), lysine (Lys:K), alanine (Ala: A), arginine (Arg:R), cysteine (Cys:C), tryptophan (Trp:W), valine (Val:V), glutamine (Gln:Q) methionine (Met:M), asparagines (Asn:N), where the amino acid is listed first followed parenthetically by the three and one letter codes, respectively.

Hybridizing Oligonucleotides

In some embodiments, oligonucleotides, including those which function via a hybridization mechanism, whether single of double stranded such as antisense molecules, RNAi constructs (including siRNA, saRNA, microRNA, etc.), aptamers and ribozymes may be used to alter or as perturbation stimuli of the gene signaling networks associated with a urea cycle-related gene.

As such oligonucleotides may also serve as therapeutics, their therapeutic liabilities and treatment outcomes may be ameliorated or predicted, respectively by interrogating the gene signaling networks.

In some embodiments, the compound comprises an siRNA. In some embodiments, compound is an siRNA compound that inhibits a target selected from the group consisting of JAK1, JAK2, JAK3, STAT5A, STAT5B, HSP90, and IRF9. In some embodiments, compound is an siRNA compound that inhibits JAK1. In some embodiments, compound is an siRNA compound that inhibits JAK2. In some embodiments, compound is an siRNA compound that inhibits JAK3. In some embodiments, compound is an siRNA compound that inhibits STAT5A. In some embodiments, compound is an siRNA compound that inhibits STAT5B. In some embodiments, compound is an siRNA compound that inhibits HSP90. In some embodiments, compound is an siRNA compound that inhibits IRF9. In some embodiments, the IRF9 siRNA is Dharmacon/Horizon Discovery #M-020858-02-0005, L-020858-00-0005, J-020858-06-0005, J-020858-07-0005, J-020858-08-0005, J-020858-09-0005, or LQ-020858-00-0005.

siRNA that target the indicated genes are commerically available from various vendors, including Horizon Disovery, which provides the Dharmacon line of siRNA. Multiple types of siRNA are available from Horizon Discovery under the Dharmacon brand, including the siRNA siGENOME and ON-TARGETplus reagents, which both can be purchased individually or as a set of SMARTpool siRNA reagents. Exemplary Dharmacon siRNA for targeting genes that modulate urea cycle genes include, but are not limited to, JAK1 siRNA Dharmacon #M-003145-02-0005; JAK2 siRNA Dharmacon #M-003146-02-0005; JAK3 siRNA Dharmacon #M-020858-02-0005; TYK2 siRNA Dharmacon #M-003182-02-0005; STAT1 siRNA Dharmacon #M-003543-01-0005; STAT2 siRNA Dharmacon #M-012064-00-0005; STAT3 siRNA Dharmacon #M-003544-02-0005; STAT4 siRNA Dharmacon #M-011784-01-0005; STAT5B siRNA Dharmacon #M-010539-02-0005; STAT5A siRNA Dharmacon #M-005169-02-0005; IRF1 siRNA Dharmacon #M-011704-01-0005; IRF2 siRNA Dharmacon #M-011705-01-0005; IRF7 siRNA Dharmacon #M-011810-02-0005; IRF8 siRNA Dharmacon #M-011699-01-0005; IRF9 siRNA Dharmacon #M-020858-02-0005.

Genome Editing Approaches

In certain embodiments, expression of a urea cycle-related gene may be modulated by altering the chromosomal regions defining the insulated neighborhood(s) and/or genome signaling center(s) associated with the urea cycle-related gene. For example, protein production may be increased by targeting a component of the gene signaling network that functions to repress the expression of the urea cycle-related gene.

Methods of altering the gene expression attendant to an insulated neighborhood include altering the signaling center (e.g., using CRISPR/Cas to change the signaling center binding site or repair/replace if mutated). These alterations may result in a variety of results including: activation of cell death pathways prematurely/inappropriately (key to many immune disorders), production of too little/much gene product (also known as the rheostat hypothesis), production of too little/much extracellular secretion of enzymes, prevention of lineage differentiation, switch of lineage pathways, promotion of stemness, initiation or interference with auto regulatory feedback loops, initiation of errors in cell metabolism, inappropriate imprinting/gene silencing, and formation of flawed chromatin states. Additionally, genome editing approaches including those well-known in the art may be used to create new signaling centers by altering the cohesin necklace or moving genes and enhancers.

In certain embodiments, genome editing approaches describe herein may include methods of using site-specific nucleases to introduce single-strand or double-strand DNA breaks at particular locations within the genome. Such breaks can be and regularly are repaired by endogenous cellular processes, such as homology-directed repair (HDR) and non-homologous end joining (NHEJ). HDR is essentially an error-free mechanism that repairs double-strand DNA breaks in the presence of a homologous DNA sequence. The most common form of HDR is homologous recombination. It utilizes a homologous sequence as a template for inserting or replacing a specific DNA sequence at the break point. The template for the homologous DNA sequence can be an endogenous sequence (e.g., a sister chromatid), or an exogenous or supplied sequence (e.g., plasmid or an oligonucleotide). As such, HDR may be utilized to introduce precise alterations such as replacement or insertion at desired regions. In contrast, NHEJ is an error-prone repair mechanism that directly joins the DNA ends resulting from a double-strand break with the possibility of losing, adding or mutating a few nucleotides at the cleavage site. The resulting small deletions or insertions (termed "Indels") or mutations may disrupt or enhance gene expression. Additionally, if there are two breaks on the same DNA, NHEJ can lead to the deletion or inversion of the intervening segment. Therefore, NHEJ may be utilized to introduce insertions, deletions or mutations at the cleavage site.

CRISPR/Cas Systems

In certain embodiments, a CRISPR/Cas system may be used to delete CTCF anchor sites to modulate gene expression within the insulated neighborhood associated with that anchor site. See, Hnisz et al., Cell 167, Nov. 17, 2016, which is hereby incorporated by reference in its entirety. Disruption of the boundaries of insulated neighborhood prevents the interactions necessary for proper function of the associated signaling centers. Changes in the expression genes that are immediately adjacent to the deleted neighborhood boundary have also been observed due to such disruptions.

In certain embodiments, a CRISPR/Cas system may be used to modify existing CTCF anchor sites. For example, existing CTCF anchor sites may be mutated or inverted by inducing NHEJ with a CRISPR/Cas nuclease and one or more guide RNAs, or masked by targeted binding with a catalytically inactive CRISPR/Cas enzyme and one or more guide RNAs. Alteration of existing CTCF anchor sites may disrupt the formation of existing insulated neighborhoods and alter the expression of genes located within these insulated neighborhoods.

In certain embodiments, a CRISPR/Cas system may be used to introduce new CTCF anchor sites. CTCF anchor sites may be introduced by inducing HDR at a selected site with a CRISPR/Cas nuclease, one or more guide RNAs and a donor template containing the sequence of a CTCF anchor site. Introduction of new CTCF anchor sites may create new insulated neighborhoods and/or alter existing insulated neighborhoods, which may affect expression of genes that are located adjacent to these insulated neighborhoods.

In certain embodiments, a CRISPR/Cas system may be used to alter signaling centers by changing signaling center binding sites. For example, if a signaling center binding site contains a mutation that affects the assembly of the signaling center with associated transcription factors, the mutated site may be repaired by inducing a double strand DNA break at or near the mutation using a CRISPR/Cas nuclease and one or more guide RNAs in the presence of a supplied corrected donor template.

In certain embodiments, a CRISPR/Cas system may be used to modulate expression of neighborhood genes by binding to a region within an insulated neighborhood (e.g., enhancer) and block transcription. Such binding may prevent recruitment of transcription factors to signaling centers and initiation of transcription. The CRISPR/Cas system may be a catalytically inactive CRISPR/Cas system that do not cleave DNA.

In certain embodiments, a CRISPR/Cas system may be used to knockdown expression of neighborhood genes via introduction of short deletions in coding regions of these genes. When repaired, such deletions would result in frame shifts and/or introduce premature stop codons in mRNA produced by the genes followed by the mRNA degradation via nonsense-mediated decay. This may be useful for modulation of expression of activating and repressive components of signaling pathways that would result in decreased or increased expression of genes under control of these pathways including disease genes such as CPS1, OTC, ASS, ASL, NAGS, and ARG1.

In other embodiments, a CRISPR/Cas system may also be used to alter cohesion necklace or moving genes and enhancers.

CRISPR/Cas Enzymes

CRISPR/Cas systems are bacterial adaptive immune systems that utilize RNA-guided endonucleases to target specific sequences and degrade target nucleic acids. They have been adapted for use in various applications in the field of genome editing and/or transcription modulation. Any of the enzymes or orthologs known in the art or disclosed herein may be utilized in the methods herein for genome editing.

In certain embodiments, the CRISPR/Cas system may be a Type II CRISPR/Cas9 system. Cas9 is an endonuclease that functions together with a trans-activating CRISPR RNA (tracrRNA) and a CRISPR RNA (crRNA) to cleave double stranded DNAs. The two RNAs can be engineered to form a single-molecule guide RNA by connecting the 3' end of the crRNA to the 5' end of tracrRNA with a linker loop. Jinek et al., Science, 337(6096):816-821 (2012) showed that the CRISPR/Cas9 system is useful for RNA-programmable genome editing, and international patent application WO2013/176772 provides numerous examples and applications of the CRISPR/Cas endonuclease system for site-specific gene editing, which are incorporated herein by reference in their entirety. Exemplary CRISPR/Cas9 systems include those derived from *Streptococcus pyogenes, Streptococcus thermophilus, Neisseria meningitidis, Treponema denticola, Streptococcus aureas*, and *Francisella tularensis*.

In certain embodiments, the CRISPR/Cas system may be a Type V CRISPR/Cpf1 system. Cpf1 is a single RNA-guided endonuclease that, in contrast to Type II systems, lacks tracrRNA. Cpf1 produces staggered DNA double-stranded break with a 4 or 5 nucleotide 5' overhang. Zetsche et al. Cell. 2015 Oct. 22; 163(3):759-71 provides examples of Cpf1 endonuclease that can be used in genome editing applications, which is incorporated herein by reference in its entirety. Exemplary CRISPR/Cpf1 systems include those derived from *Francisella tularensis*, Acidaminococcus sp., and Lachnospiraceae bacterium.

In certain embodiments, nickase variants of the CRISPR/Cas endonucleases that have one or the other nuclease domain inactivated may be used to increase the specificity of CRISPR-mediated genome editing. Nickases have been shown to promote HDR versus NHEJ. HDR can be directed from individual Cas nickases or using pairs of nickases that flank the target area.

In certain embodiments, catalytically inactive CRISPR/Cas systems may be used to bind to target regions (e.g., CTCF anchor sites or enhancers) and interfere with their function. Cas nucleases such as Cas9 and Cpf1 encompass two nuclease domains. Mutating critical residues at the catalytic sites creates variants that only bind to target sites but do not result in cleavage. Binding to chromosomal regions (e.g., CTCF anchor sites or enhancers) may disrupt proper formation of insulated neighborhoods or signaling centers and therefore lead to altered expression of genes located adjacent to the target region.

In certain embodiments, a CRISPR/Cas system may include additional functional domain(s) fused to the CRISPR/Cas enzyme. The functional domains may be involved in processes including but not limited to transcription activation, transcription repression, DNA methylation, histone modification, and/or chromatin remodeling. Such functional domains include but are not limited to a transcriptional activation domain (e.g., VP64 or KRAB, SID or SID4X), a transcriptional repressor, a recombinase, a transposase, a histone remodeler, a DNA methyltransferase, a cryptochrome, a light inducible/controllable domain or a chemically inducible/controllable domain.

In certain embodiments, a CRISPR/Cas enzyme may be administered to a cell or a patient as one or a combination of the following: one or more polypeptides, one or more mRNAs encoding the polypeptide, or one or more DNAs encoding the polypeptide.

Guide Nucleic Acid

In certain embodiments, guide nucleic acids may be used to direct the activities of an associated CRISPR/Cas enzymes to a specific target sequence within a target nucleic acid. Guide nucleic acids provide target specificity to the guide nucleic acid and CRISPR/Cas complexes by virtue of their association with the CRISPR/Cas enzymes, and the guide nucleic acids thus can direct the activity of the CRISPR/Cas enzymes.

In one aspect, guide nucleic acids may be RNA molecules. In one aspect, guide RNAs may be single-molecule guide RNAs. In one aspect, guide RNAs may be chemically modified.

In certain embodiments, more than one guide RNAs may be provided to mediate multiple CRISPR/Cas-mediated activities at different sites within the genome.

In certain embodiments, guide RNAs may be administered to a cell or a patient as one or more RNA molecules or one or more DNAs encoding the RNA sequences.

Ribonucleoprotein Complexes (RNPs)

In one embodiment, the CRISPR/Cas enzyme and guide nucleic acid may each be administered separately to a cell or a patient.

In another embodiment, the CRISPR/Cas enzyme may be pre-complexed with one or more guide nucleic acids. The pre-complexed material may then be administered to a cell or a patient. Such pre-complexed material is known as a ribonucleoprotein particle (RNP).

Zinc Finger Nucleases

In certain embodiments, genome editing approaches provided herein involve the use of Zinc finger nucleases (ZFNs). Zinc finger nucleases (ZFNs) are modular proteins comprised of an engineered zinc finger DNA binding domain linked to a DNA-cleavage domain. A typical DNA-cleavage domain is the catalytic domain of the type II endonuclease FokI. Because FokI functions only as a dimer, a pair of ZFNs must are required to be engineered to bind to cognate target "half-site" sequences on opposite DNA strands and with precise spacing between them to allow the two enable the catalytically active FokI domains to dimerize. Upon dimerization of the FokI domain, which itself has no sequence specificity per se, a DNA double-strand break is generated between the ZFN half-sites as the initiating step in genome editing.

Transcription Activator-Like Effector Nucleases (TALENs)

In certain embodiments, genome editing approaches provided herein involve the use of Transcription Activator-Like Effector Nucleases (TALENs). TALENs represent another format of modular nucleases which, similarly to ZFNs, are generated by fusing an engineered DNA binding domain to a nuclease domain, and operate in tandem to achieve targeted DNA cleavage. While the DNA binding domain in ZFN consists of Zinc finger motifs, the TALEN DNA binding domain is derived from transcription activator-like effector (TALE) proteins, which were originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Modulation of Urea Cycle-Related Genes

Compositions and methods described herein may be effective in modulating the expression of one or more urea cycle-related genes. Such compositions and methods may be used to treat a urea cycle disorder.

In some embodiments, compositions and methods provided herein may be used to treat a urea cycle disorder by modulating the expression of CPS1. Compounds that may be used to modulate the CPS1 expression include, but are not limited to, Dasatinib, R788 (fostamatinib disodium hexahydrate), Bosutinib, Epinephrine, FRAX597, Merestinib, Deoxycorticosterone, 17-AAG (Tanespimycin), GDF2 (BMP9), GZD824 Dimesylate, PND-1186, Wnt3a, Nodal, Anti mullerian hormone, TNF-α, Activin, IGF-1, prednisone, PDGF, HGF/SF, EGF, BAY 87-2243, CP-673451, FGF, GDF10 (BMP3b), LDN193189, Amuvatinib, Momelotinib, Echinomycin, Pacritinib (SB1518), BMP2, Crizotinib, LDN-212854, Thalidomide, CO-1686 (Rociletinib), Zibotentan, and derivatives or analogs thereof. In some embodiments, Dasatinib perturbs the ABL signaling pathway to modulate CPS1 expression. In some embodiments, R788 (fostamatinib disodium hexahydrate) perturbs the Protein Tyrosine Kinase/RTK signaling pathway to modulate CPS1 expression. In some embodiments, Bosutinib perturbs the Src signaling pathway to modulate CPS1 expression. In some embodiments, Epinephrine perturbs the Adrenergic receptor signaling pathway to modulate CPS1 expression. In some embodiments, FRAX597 perturbs the PAK signaling pathway to modulate CPS1 expression. In some embodiments, Merestinib perturbs the c-MET signaling pathway to modulate CPS1 expression. In some embodiments, Corticosterone perturbs the Mineralcorticoid receptor signaling pathway to modulate CPS1 expression. In some embodiments, 17-AAG (Tanespimycin) perturbs the Cell Cycle/DNA Damage Metabolic Enzyme/Protease signaling pathway to modulate CPS1 expression. In some embodiments, GDF2 (BMP9) perturbs the TGF-B signaling pathway to modulate CPS1 expression. In some embodiments, GZD824 Dimesylate perturbs the ABL signaling pathway to modulate CPS1 expression. In some embodiments, PND-1186 perturbs the FAK signaling pathway to modulate CPS1 expression. In some embodiments, Wnt3a perturbs the WNT signaling pathway to modulate CPS1 expression. In some embodiments, Nodal perturbs the TGF-B signaling pathway to modulate CPS1 expression. In some embodiments, Anti mullerian hormone perturbs the TGF-B signaling pathway to modulate CPS1 expression. In some embodiments, TNF-α perturbs the NF-kB, MAPK, or Apoptosis pathway to modulate CPS1 expression. In some embodiments, Activin perturbs the TGF-B signaling pathway to modulate CPS1 expression. In some embodiments, IGF-1 perturbs the IGF-1R/InsR signaling pathway to modulate CPS1 expression. In some embodiments, prednisone perturbs the GR signaling pathway to modulate CPS1 expression. In some embodiments, PDGF perturbs the PDGFR signaling pathway to modulate CPS1 expression. In some embodiments, HGF/SF perturbs the c-MET signaling pathway to modulate CPS1 expression. In some embodiments, EGF perturbs the EGFR signaling pathway to modulate CPS1 expression. In some embodiments, BAY 87-2243 perturbs the Hypoxia activated signaling pathway to modulate CPS1 expression. In some embodiments, CP-673451 perturbs the PDGFR signaling pathway to modulate CPS1 expression. In some embodiments, FGF perturbs the FGFR signaling pathway to modulate CPS1 expression. In some embodiments, GDF10 (BMP3b) perturbs the TGF-B signaling pathway to modulate CPS1 expression. In some embodiments, LDN193189 perturbs the TGF-B signaling pathway to modulate CPS1 expression. In some embodiments, Amuvatinib perturbs the PDGFR signaling pathway to modulate CPS1 expression. In some embodiments, Momelotinib perturbs the JAK/STAT signaling pathway to modulate CPS1 expression. In some embodiments, Echinomycin perturbs the Hypoxia activated signaling pathway to modulate CPS1 expression. In some embodiments, Pacritinib (SB1518) perturbs the JAK/STAT signaling pathway to modulate CPS1 expression. In some embodiments, BMP2 perturbs the TGF-B signaling pathway to modulate CPS1 expression. In some embodiments, Crizotinib perturbs the c-MET signaling pathway to modulate CPS1 expression. In some embodiments, LDN-212854 perturbs the TGF-B signaling pathway to modulate CPS1 expression. In some embodiments, Thalidomide perturbs the NF-kB signaling pathway to modulate CPS1 expression. In some embodiments, CO-1686 (Rociletinib) perturbs the JAK/STAT and/or Tyrosine Kinase/RTK signaling pathway to modulate CPS1 expression. In some embodiments, Zibotentan perturbs the GPCR/G protein signaling pathway to modulate CPS1 expression.

In some embodiments, methods provided herein involve altering the composition and/or the structure of the insulated neighborhood containing the CPS1 gene. The CPS1 gene has a cytogenetic location of 2q34 and the genomic coordinate are on Chromosome 2 on the forward strand at position 210,477,682-210,679,107. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of CPS1. The chromatin marks and/or chromatin-associated proteins may include but are not limited to H3K27ac, BRD4, p300, and SMC1. The transcription factors may include but are not limited to FOXA2, HNF4A, ONECUT1, ONECUT2, and YY1. The signaling proteins may include but are not limited to TCF7L2, ESRA, FOS, NR3C1, JUN, NR5A2, RBPJK, RXR, STAT3, NR1I1, NF-kB, SMAD2/3, SMAD4, STAT1, TEAD1, and TP53.

In some embodiments, compositions and methods provided herein may be used to treat a urea cycle disorder by modulating the expression of OTC. Compounds that may be used to modulate the OTC expression include, but are not limited to, CP-673451, Pacritinib (SB1518), Echinomycin, Crenolanib, Thalidomide, Amuvatinib, Dasatinib, Momelotinib, Activin, Wnt3a, INNO-206 (aldoxorubicin), TNF-α, Anti mullerian hormone, Pifithrin-µ, PDGF, IGF-1, FRAX597, Nodal, FGF, HGF/SF, BIRB 796, and derivatives or analogs thereof. In some embodiments, CP-673451 perturbs the PDGFR signaling pathway to modulate OTC expression. In some embodiments, Pacritinib (SB1518) perturbs the JAK/STAT signaling pathway to modulate OTC expression. In some embodiments. Echinomycin perturbs the Hypoxia activated signaling pathway to modulate OTC expression. In some embodiments, Crenolanib perturbs the PDGFR signaling pathway to modulate OTC expression. In some embodiments, Thalidomide perturbs the NF-kB signaling pathway to modulate OTC expression. In some embodiments, Amuvatinib perturbs the PDGFR signaling pathway to modulate OTC expression. In some embodiments, Dasatinib perturbs the ABL signaling pathway to modulate OTC expression. In some embodiments, Momelotinib perturbs the JAK/STAT signaling pathway to modulate OTC expression. In some embodiments, Activin perturbs the TGF-B signaling pathway to modulate OTC expression. In some embodiments, Wnt3a perturbs the WNT signaling pathway to modulate OTC expression. In some embodiments, INNO-206 (aldoxorubicin) perturbs the Cell Cycle/DNA Damage pathway to modulate OTC expression. In some embodiments, TNF-α perturbs the INF-kB, MAPK, or Apoptosis signaling pathway to modulate OTC expression. In some embodiments, Anti mullerian hormone perturbs the TGF-B signaling pathway to modulate OTC expression. In some embodiments, Pifithrin-µ perturbs the p53 signaling pathway to modulate OTC expression. In some embodiments, PDGF perturbs the PDGFR signaling pathway to modulate OTC expression. In some embodiments, IGF-1 perturbs the IGF-1R/InsR signaling pathway to modulate OTC expression. In some embodiments, FRAX597 perturbs the PAK signaling pathway to modulate OTC expression. In some embodiments. Nodal perturbs the TGF-B signaling pathway to modulate OTC expression. In some embodiments, EGF perturbs the EGFR signaling pathway to modulate OTC expression. In some embodiments, perturbs the FGFR signaling pathway to modulate OTC expression. In some embodiments, HGF/SF perturbs the c-MET signaling pathway to modulate OTC expression. In some embodiments, BIRB 796 perturbs the MAPK signaling pathway to modulate OTC expression.

In some embodiments, methods provided herein involve altering the composition and/or the structure of the insulated neighborhood containing the OTC gene. The OTC gene has a cytogenetic location of Xp11.4 and the genomic coordinate are on Chromosome X on the forward strand at position 38,352,545-38,421,450. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of OTC. The chromatin marks and/or chromatin-associated proteins may include but are not limited to H3K27ac and BRD4. The transcription factors may include but are not limited to FOXA2, HNF4A, ONECUT1, ONECUT2, YY1, and HNF1A. The signaling proteins may include but are not limited to TCF7L2, HIF1a, ESRA, NR3C1, JUN, RXR, STAT3, NF-kB, SMAD2/3, SMAD4, and TEAD1.

In some embodiments, compositions and methods provided herein may be used to treat a urea cycle disorder by modulating the expression of ASS1. Compounds that may be used to modulate the ASS1 expression include, but are not limited to, Dasatinib, CP-673451, Echinomycin, GDF2 (BMP9), Pacritinib (SB1518), Epinephrine, FRAX597, Bosutinib, TP-434 (Eravacycline), BMP2, SMI-4a, Amuvatinib, Crenolanib, Deoxycorticosterone, INNO-206 (aldoxorubicin), TNF-α, T0901317, and derivatives or analogs thereof. In some embodiments, Dasatinib perturbs the ABL signaling pathway to modulate ASS1 expression. In some embodiments, CP-673451 perturbs the PDGFR signaling pathway to modulate ASS1 expression. In some embodiments, Echinomycin perturbs the Hypoxia activated signaling pathway to modulate ASS1 expression. In some embodiments, GDF2 (BMP9) perturbs the TGF-B signaling pathway to modulate ASS1 expression. In some embodiments, Pacritinib (SB1518) perturbs the JAK/STAT signaling pathway to modulate ASS1 expression. In some embodiments, Epinephrine perturbs the Adrenergic receptor signaling pathway to modulate ASS1 expression. In some embodiments, FRAX597 perturbs the PAK signaling pathway to modulate ASS1 expression. In some embodiments, Bosutinib perturbs the Src signaling pathway to modulate ASS1 expression. In some embodiments, TP-434 (Eravacycline) perturbs the Tetracycline-specific efflux signaling pathway to modulate ASS1 expression. In some embodiments, BMP2 perturbs the TGF-B signaling pathway to modulate ASS1 expression. In some embodiments, SMI-4a perturbs the PIM signaling pathway to modulate ASS1 expression. In some embodiments, Amuvatinib perturbs the PDGFR signaling pathway to modulate ASS1 expression. In some embodiments, Crenolanib perturbs the PDGFR signaling pathway to modulate ASS1 expression. In some embodiments, Corticosterone perturbs the Mineralcorticoid receptor signaling pathway to modulate ASS1 expression. In some embodiments, INNO-206 (aldoxorubicin) perturbs the Cell Cycle/DNA Damage pathway to modulate ASS1 expression. In some embodiments, TNF-α perturbs the NF-kB, MAPK, or apoptosis pathway to modulate ASS1 expression. In some embodiments, T0901317 perturbs the LXR signaling pathway to modulate ASS1 expression.

In some embodiments, methods provided herein involve altering the composition and/or the structure of the insulated neighborhood containing the ASS1 gene. The ASS1 gene has a cytogenetic location of 9q34.11 and the genomic coordinate are on Chromosome 9 on the forward strand at position 130,444,929-130,501,274. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of ASS1. The chromatin marks and/or chromatin-associated proteins may include but are not limited to H3K27ac, BRD4, p300, and SMC1. The transcription factors may include but are not limited to FOXA2, HNF4A, ONECUT1, MYC, and YY1. The signaling proteins may include but are not limited to CREB1, NR1H4, HIF1a, ESRA, JUN, RXR, STAT3, NR1I1, NF-kB, NR3C1, SMAD2/3, SMAD4, and TEAD1.

In some embodiments, compositions and methods provided herein may be used to treat a urea cycle disorder by modulating the expression of ASL. Compounds that may be used to modulate the ASL expression include, but are not limited to, CP-673451, Echinomycin, Pacritinib (SB1518), Dasatinib, Oligomycin A, Merestinib, Amuvatinib, Crenolanib, Epinephrine, BAY 87-2243, Thalidomide, and derivatives or analogs thereof. In some embodiments, CP-673451 perturbs the PDGFR signaling pathway to modulate ASL expression. In some embodiments, Echinomycin perturbs the Hypoxia activated signaling pathway to modulate ASL expression. In some embodiments, Pacritinib (SB1518) perturbs the JAK/STAT signaling pathway to modulate ASL expression. In some embodiments, Dasatinib perturbs the ABL signaling pathway to modulate ASL expression. In some embodiments, Oligomycin A perturbs the ATP channel signaling pathway to modulate ASL expression. In some embodiments, Merestinib perturbs the c-MET signaling pathway to modulate ASL expression. In some embodiments, Amuvatinib perturbs the PDGFR signaling pathway to modulate ASL expression. In some embodiments, Crenolanib perturbs the PDGFR signaling pathway to modulate ASL expression. In some embodiments, Epinephrine perturbs the Adrenergic receptor signaling pathway to modulate ASL expression. In some embodiments, BAY 87-2243 perturbs the Hypoxia activated signaling pathway to modulate ASL expression. In some embodiments, Thalidomide perturbs the NF-kB signaling pathway to modulate ASL expression.

In some embodiments, methods provided herein involve altering the composition and/or the structure of the insulated neighborhood containing the ASL gene. The ASL gene has a cytogenetic location of 7q11.21 and the genomic coordinate are on Chromosome 7 on the forward strand at position 66,075,798-66,093,558. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of ASL. The chromatin marks and/or chromatin-associated proteins may include but are not limited to H3K27ac, BRD4, and p300. The transcription factors may include but are not limited to HNF3, HNF4A, ONECUT1, HNF1A, and MYC. The signaling proteins may include but are not limited to TCF7L2, CREB1, NR1H4, HIF1a, ESRA, FOS, JUN, RBPJK, RXR, STAT3, NR1I1, NF-kB, NR3C1, SMAD2/3, SMAD4, STAT1, TEAD1, and TP53.

In some embodiments, compositions and methods provided herein may be used to treat a urea cycle disorder by modulating the expression of NAGS. Compounds that may be used to modulate the NAGS expression include, but are not limited to, AZD2858, Enzastaurin, Bosutinib, Semaxanib, INNO-206 (aldoxorubicin), TP-434 (Eravacycline), Phenformin, Crizotinib, SMI-4a, Dasatinib, Calcitriol, Pifithrin-µ, PHA-665752, Darapladib, Thalidomide, CO-1686 (Rociletinib), OSU-03012, prednisone, GSK2334470, Afatinib, Tivozanib, SKL2001, GDC-0879, EVP-6124 (hydrochloride) (encenicline), Amlodipine Besylate, T0901317, 006983, Activin, WYE-125132 (WYE-132), SIS3, GDF2 (BMP9), Phorbol 12,13-dibutyrate, CD 2665, Erlotinib, Ceritinib, BMP2, HGF/SF, C1-4 AS-1, and derivatives or analogs thereof. In some embodiments, AZD2858 perturbs the GSK-3 signaling pathway to modulate NAGS expression. In some embodiments, Enzastaurin perturbs the Epigenetics or TGF-beta/Smad signaling pathway to modulate NAGS expression. In some embodiments, Bosutinib perturbs the Src signaling pathway to modulate NAGS expression. In some embodiments, Semaxanib perturbs the VEGFR signaling pathway to modulate NAGS expression. In some embodiments, INNO-206 (aldoxorubicin) perturbs the Cell Cycle/DNA Damage pathway to modulate NAGS expression. In some embodiments, TP-434 (Eravacycline) perturbs the Tetracycline-specific efflux signaling pathway to modulate NAGS expression. In some embodiments, Phenformin perturbs the AMPK signaling pathway to modulate NAGS expression. In some embodiments, Crizotinib perturbs the c-MET signaling pathway to modulate NAGS expression. In some embodiments, SMI-4a perturbs the PIM signaling pathway to modulate NAGS expression. In some embodiments, Dasatinib perturbs the ABL signaling pathway to modulate NAGS expression. In some embodiments, Calcitriol perturbs the Vitamin D Receptor signaling pathway to modulate NAGS expression. In some embodiments, Pifithrin-μ perturbs the p53 signaling pathway to modulate NAGS expression. In some embodiments, PHA-665752 perturbs the c-MET signaling pathway to modulate NAGS expression. In some embodiments, Thalidomide perturbs the NF-kB signaling pathway to modulate NAGS expression. In some embodiments, CO-1686 (Rociletinib) perturbs the JAK/STAT or Tyrosine Kinase/RTK signaling pathway to modulate NAGS expression. In some embodiments, OSU-03012 perturbs the PDK-1 signaling pathway to modulate NAGS expression. In some embodiments, prednisone perturbs the GR signaling pathway to modulate NAGS expression. In some embodiments, GSK2334470 perturbs the PDK-1 signaling pathway to modulate NAGS expression. In some embodiments, Afatinib perturbs the EGFR signaling pathway to modulate NAGS expression. In some embodiments, Tivozanib perturbs the Protein Tyrosine Kinase/RTK signaling pathway to modulate NAGS expression. In some embodiments, SKL2001 perturbs the WNT signaling pathway to modulate NAGS expression. In some embodiments, GDC-0879 perturbs the MAPK signaling pathway to modulate NAGS expression. In some embodiments, EVP-6124 (hydrochloride) (encenicline) perturbs the Membrane Transporter/Ion Channel signaling pathway to modulate NAGS expression. In some embodiments, Amlodipine Besylate perturbs the Calcium channel signaling pathway to modulate NAGS expression. In some embodiments, 10901317 perturbs the Da signaling pathway to modulate NAGS expression. In some embodiments, GO6983 perturbs the PKC signaling; pathway to modulate NAGS expression. In some embodiments, Activin perturbs the TGF-B signaling pathway to modulate NAGS expression. In some embodiments, WYE-125132 (WYE-132) perturbs the mTOR signaling pathway to modulate NAGS expression. In some embodiments, SIS3 perturbs the TGF-B signaling pathway to modulate NAGS expression. In some embodiments, GDF2 (BMP9) perturbs the TGF-B signaling pathway to modulate NAGS expression. In some embodiments, Phorbol 12,13-dibutyrate perturbs the PKC signaling pathway to modulate NAGS expression. In some embodiments, CD 2665 perturbs the RAR signaling pathway to modulate NAGS expression. In some embodiments. Erlotinib perturbs the EGFR signaling pathway to modulate NAGS expression. In some embodiments, Ceritinib perturbs the ALK signaling pathway to modulate NAGS expression. In some embodiments, BMP2 perturbs the TGF-B signaling pathway to modulate NAGS expression. In some embodiments, TFP perturbs the Calmodulin signaling pathway to modulate NAGS expression. In some embodiments, HGF/SF perturbs the c-MET signaling pathway to modulate NAGS expression. In some embodiments, CI-4AS-1 perturbs the Androgen receptor signaling; pathway to modulate NAGS expression.

In some embodiments, methods provided herein involve altering the composition and/or the structure of the insulated neighborhood containing the NAGS gene. The NAGS gene has a cytogenetic location of 17q21.31 and the genomic coordinate are on Chromosome 17 on the forward strand at position 44,004,546-44,009,063. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of NAGS. The chromatin marks and/or chromatin-associated proteins may include but are not limited to H3K27ac, BRD4, and p300. The transcription factors may include but are not limited to FOXA2, HNF4A, ONECUT1, ONECUT2, YY1, and HNF1A. The signaling proteins may include but are not limited to TCF7L2, HIF1a, AHR, ESRA, JUN, RXR, STAT3, NR1I1, NF-kB, NR3C1, SMAD2/3, SMAD4, TEAD1, and TP53.

In some embodiments, compositions and methods provided herein may be used to treat a urea cycle disorder by modulating the expression of ARG1. Compounds that may be used to modulate the ARG1 expression include, but are not limited to, R788 (fostamatinib disodium hexahydrate), Dasatinib, CP-673451, Merestinib, Echinomycin, Amuvatinib, Epinephrine, Bosutinib, Wnt3a, Anti mullerian Hormone, Nodal, Activin, 7-AAG (Tanespimycin), TNF-a, Pifithrin-μ, PDGF, Pacritinib (SB1518), GDF2 (BMP9), Crenolanib, prednisone, HGF/SF, Momelotinib, EGF, Deoxycorticosterone, FGF, Thalidomide, Phenformin, Tivozanib, BAY 87-2243, GZD824 Dimesylate, GDF10 (BMP3b), PND-1186, FRAX597, BMP2, Oligomycin A, Rifampicin, MK-0752, and derivatives or analogs thereof. In some embodiments, R788 (fostamatinib disodium hexahydrate) perturbs the Protein Tyrosine Kinase/RTK signaling pathway to modulate ARG1 expression. In some embodiments, Dasatinib perturbs the ABL signaling pathway to modulate ARG1 expression. In some embodiments, CP-673451 perturbs the PDGFR signaling pathway to modulate ARG1 expression. In some embodiments, Merestinib perturbs the c-MET signaling pathway to modulate ARG1 expression. In some embodiments, Echinomycin perturbs the Hypoxia activated signaling pathway to modulate ARG1 expression. In some embodiments, Amuvatinib perturbs the PDGFR signaling pathway to modulate ARG1 expression. In some embodiments, Epinephrine perturbs the Adrenergic receptor signaling pathway to modulate ARG1 expression. In some embodiments, Bosutinib perturbs the Src signaling pathway to modulate ARG1 expression. In some embodiments, Wnt3a perturbs the WNT signaling pathway to modulate ARG1 expression. In some embodiments, Anti mullerian Hormone perturbs the TGF-B signaling pathway to modulate ARG1 expression. In some embodiments, Nodal perturbs the TGF-B signaling pathway to modulate ARG1 expression. In some embodiments, Activin perturbs the TGF-B signaling pathway to modulate ARG1 expression. In some embodiments, IGF-1 perturbs the IGF-1R/InsR signaling pathway to modulate ARG1 expression. In some embodiments, 17-AAG (Tanespimycin) perturbs the Cell Cycle/DNA Damage Metabolic Enzyme/Protease signaling pathway to modulate ARG1 expression. In some embodiments, TNF-α perturbs the NE-kB, MAPK, or Apoptosis pathway to modulate ARG1 expression. In some embodiments, Pifithrin-μ perturbs the p53 signaling pathway to modulate ARG1 expression. In some embodiments, PDGF perturbs the PDGFR signaling pathway to modulate ARG1 expression. In some embodiments, Pacritinib (SB1518) perturbs the JAK/STAT signaling pathway to modulate ARG1 expression. In some embodiments, GDF2 (BMP9) perturbs the TGF-B signaling pathway to modulate ARG1 expression. In some embodiments, Crenolanib perturbs the PDGFR signaling pathway to modulate ARG1 expression. In some embodiments, prednisone perturbs the GR signaling pathway to modulate ARG1 expression. In some embodiments, HGF/SF perturbs the c-MET signaling pathway to modulate ARG1 expression. In some embodiments, Momelotinib perturbs the JAK/STAT signaling pathway to modulate ARG1 expression. In some embodiments, EGF perturbs the EGFR signaling pathway to modulate ARG1 expression. In some embodiments, Corticosterone perturbs the Mineralcorticoid receptor signaling pathway to modulate ARG1 expression. In some embodiments, FGF perturbs the FGFR signaling pathway to modulate ARG1 expression. In some embodiments, Thalidomide perturbs the NF-kB signaling pathway to modulate ARG1 expression. In some embodiments, Phenformin perturbs the AMPK signaling pathway to modulate ARG1 expression. In some embodiments, Tivozanib perturbs the Protein Tyrosine Kinase/RTK signaling pathway to modulate ARG1 expression. In some embodiments, BAY 87-2243 perturbs the Hypoxia activated signaling pathway to modulate ARG1 expression. In some embodiments, GZD824 Dimesylate perturbs the ABL signaling pathway to modulate ARG1 expression. In some embodiments, GDF10 (BMP3b) perturbs the TGF-B signaling pathway to modulate ARG1 expression. In some embodiments, PND-1186 perturbs the FAK signaling pathway to modulate ARG1 expression. In some embodiments, FRAX597 perturbs the PAK signaling pathway to modulate ARG1 expression. In some embodiments, BMP2 perturbs the TGF-B signaling pathway to modulate ARG1 expression. In some embodiments, Oligomycin A perturbs the ATP channel signaling pathway to modulate ARG1 expression. In some embodiments, Rifampicin perturbs the PXR signaling pathway to modulate ARG1 expression. In some embodiments, MK-0752 perturbs the NOTCH signaling pathway to modulate ARG1 expression.

In some embodiments, methods provided herein involve altering the composition and/or the structure of the insulated neighborhood containing the ARG1 gene. The ARG1 gene has a cytogenetic location of 6q23.2 and the genomic coordinate are on Chromosome 6 on the forward strand at position 131,573,144-131,584,332. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of ARG1. The chromatin marks and/or chromatin-associated proteins may include but are not limited to H3K27ac, BRD4, and p300. The transcription factors may include but are not limited to FOXA2, HNF4A, ONECUT1, ONECUT2, YY1, HNF1A, and MYC. The signaling proteins may include but are not limited to HIF1a, ESRA, NR3C1, JUN, RXR, STAT3, NR1I1, SMAD2/3, STAT1, and TEAD1.

In some embodiments, compositions and methods provided herein may be used to treat a urea cycle disorder by modulating the expression of SLC25A15. Compounds that may be used to modulate the SLC25A15 expression include, but are not limited to, Dasatinib, FRAX597, Merestinib, R788 (fostamatinib disodium hexahydrate), Bosutinib, bms-986094 (inx-189), Epinephrine, GDF2 (BMP9), Echinomycin, Corticosterone, IGF-1, CP-673451, GZD824 Dimesylate, EW-7197, PDGF, Wnt3a, and derivatives or analogs thereof. In some embodiments, Dasatinib perturbs the ABL signaling pathway to modulate SLC25A15 expression. In some embodiments, FRAX597 perturbs the PAK signaling pathway to modulate SLC25A15 expression. In some embodiments, Merestinib perturbs the c-MET signaling pathway to modulate SLC25A15 expression. In some embodiments, R788 (fostamatinib disodium hexahydrate) perturbs the Protein Tyrosine Kinase/RTK signaling pathway to modulate SLC25M 5 expression. In some embodiments, Bosutinib perturbs the Src signaling pathway to modulate SLC25A15 expression. In some embodiments, Epinephrine perturbs the Adrenergic receptor signaling pathway to modulate SLC25A15 expression. In some embodiments, GDF2 (BMP9) perturbs the TGF-B signaling pathway to modulate SLC25A15 expression. In some embodiments, Echinomycin perturbs the Hypoxia activated signaling pathway to modulate SLC25A15 expression. In some embodiments, Corticosterone perturbs the Mineralcorticoid receptor signaling pathway to modulate SLC25A15 expression. In some embodiments, IGF-1 perturbs the IGF-1R/InsR signaling pathway to modulate SLC25A15 expression. In some embodiments, CP-673451 perturbs the PDGFR signaling pathway to modulate SLC25A15 expression. In some embodiments, GZD824 Dimesylate perturbs the ABL signaling pathway to modulate SLC25A15 expression. In some embodiments, EW-7197 perturbs the TGF-B signaling pathway to modulate SLC25A15 expression. In some embodiments, PDGF perturbs the PDGFR signaling pathway to modulate SLC25A15 expression. In some embodiments, Wnt3a perturbs the WNT signaling pathway to modulate SLC25A15 expression.

In some embodiments, methods provided herein involve altering the composition and/or the structure of the insulated neighborhood containing the SLC25A15 gene. SLC25A15 has a cytogenetic location of 13q14.11 and the genomic coordinate are on Chromosome 13 on the forward strand at position 40,789,412-40,810,111. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of SLC25A15. The chromatin marks and/or chromatin-associated proteins may include but are not limited to H3K27ac, and BRD4. The transcription factors may include but are not limited to FOXA2, HNF4A, ONECUT1, ONECUT2, and YY1. The signaling proteins may include but are not limited to ESRA, Jun, RXR, NR1I1, NF-kB, NR3C1, SMAD2/3, and TP53.

In some embodiments, compositions and methods provided herein may be used to treat a urea cycle disorder by modulating the expression of SLC25A13. Compounds that may be used to modulate the SLC25A13 expression include, but are not limited to, TFP, 17-AAG (Tanespimycin), and derivatives or analogs thereof. In some embodiments, TFP perturbs the Calmodulin signaling pathway to modulate SLC25A13 expression. In some embodiments, 17-AAG (Tanespimycin) perturbs the Cell Cycle/DNA Damage Metabolic Enzyme/Protease signaling pathway to modulate SLC25A13 expression.

In some embodiments, methods provided herein involve altering the composition and/or the structure of the insulated neighborhood containing the SLC25A13 gene. SLC25A13 has a cytogenetic location of 7q21.3 and the genomic coordinate are on Chromosome 7 on the reverse strand at position 96,120,220-96,322,147. Any chromatin mark, chromatin-associated protein, transcription factor and/or signaling protein that is associated with the insulated neighborhood, and/or any regions within or near the insulated neighborhood, may be targeted or altered to change the composition and/or structure of the insulated neighborhood, thereby modulating the expression of SLC25A13. The chromatin marks and/or chromatin-associated proteins may include but are not limited to H3K27ac, BRD4, p300, and SMC1. The transcription factors may include but are not limited to FOXA2, HNF4A, ONECUT1, ATF5, ONECUT2, YY1, HNF1A, and MYC. The signaling proteins may include but are not limited to TCF7L2, HIF1a, ESRA, NR3C1, JUN, RXR, STAT3, NR1I1, NF-kB, SMAD2/3, STAT1, TEAD1, and TP53.

In some embodiments, compositions and methods provided herein may be used to treat a urea cycle disorder by modulating the expression of multiple urea cycle-related genes. As a non-limiting example, methods provided herein may be used to modulate the expression of any one of the following groups of genes: NAGS, CPS1, ASS1, ASL, OTC, ARG1, and SLC25A15; CPS1, ASS1, ASL, OTC, ARG1, and SLC25A15; ASS1, CPS1, NAGS, ARG1, and SLC25A15; CPS1, ASS1, ASL, ARG1, and SLC25A15; CPS1, ASS1, ASL, OTC, and ARG1; CPS1, ASS1, OTC, ARG1, and SLC25A15; NAGS, CPS1, ALS, OTC, and ARG1; ASS1, ASL, OTC, and ARG1; ASS1, CPS1, NAGS, and ARG1; CPS1, ASS1, ARG1, and SLC25A15; CPS1, ASS1, OTC, and ARG1; CPS1, OTC, ARG1, and SLC25A15; NAGS, CPS1, OTC, and ARG1; CPS1, ARG1, and SLC25A13; CPS1, ARG1, and SLC25A15; CPS1, ASL, and ARG1; CPS1, NAGS, and ARG1; CPS1, OTC, and ARG1; NAGS, ASS1, and OTC; OTC, NAGS, and ARG1. Compounds that may be used to modulate multiple urea cycle-related genes include, but are not limited to, Dasatinib, Echinomycin, CP-673451, GDF2 (BMP9), Bosutinib, Epinephrine, Pacritinib (SB1518), Amuvatinib, FRAX597, Thalidomide, Crenolanib, BMP2, Deoxycorticosterone, TNF-α, Wnt3a, PDGF, IGF-1, Activin, HGF/SF, 17-AAG (Tanespimycin), R788 (fostamatinib disodium hexahydrate), GZD824 Dimesylate, BAY 87-2243, prednisone, Nodal, Momelotinib, FGF, EGF, Anti mullerian hormone, INNO-206 (aldoxorubicin), and Pifithrin-μ.

In some embodiments, targeting multiple urea cycle-related genes may be accomplished by utilizing a combination of compounds that each specifically modulates a urea cycle-related gene. In some embodiments, targeting multiple urea cycle-related genes may be accomplished by utilizing a single compound that is capable of modulating multiple urea cycle-related genes.

In some embodiment, compounds provided herein may be used in combination with other drugs, such as Sodium phenylbutyrate (BUPHENYL®), glycerol phenylbutyrate (RAVICTI®), and sodium benzoate, to treat a urea cycle disorder.

In certain embodiments, the compound increases the expression of OTC, CPS1, NAGS, ASS1, ARG1, SLC25A15, or SLC25A13 in the cell or subject by at least about 10%, at least about 20%, at least about 30%, at least about 40%, at least about 50%, at least about 60%, at least about 70%, at least about 80%, at least about 90%, at least about 100%, at least about 125%, at least about 150%, at least about 175%, at least about 200%, at least about 250%, at least about 300%, at least about 400%, at least about 500%, from about 25% to about 50%, from about 40% to about 60%, from about 50% to about 70%, from about 60% to about 80%, from about 80% to about 100%, from about 100% to about 125%, from about 100 to about 150%, from about 150% to about 200%, from about 200% to about 300%, from about 300% to about 400%, from about 400% to about 500%, or more than 500% as compared to OTC, CPS1, NAGS, ASS1, ARG1, SLC25A15, or SLC25A13 expression in an untreated cell, untreated subject, or untreated population or a cell, subject, or population treated with a control compound. In some embodiments, the increased expression is in a cell in a subject. In some embodiments, the compound increases the expression of OTC, CPS1, NAGS, ASS1, ARG1, SLC25A15, or SLC25A13 in the cell by about 2 fold, about 3 fold, about 4 fold, about 5 fold, about 6 fold, about 7 fold, about 8 fold, about 9 fold, about 10 fold, about 12 fold, about 15 fold, about 18 fold, about 20 fold, about 25 fold, or more than 30 fold as compared to OTC, CPS1, NAGS, ASS1, ARG1, SLC25A15, or SLC25A13 expression in an untreated cell, untreated subject, or untreated population, or a cell, subject, or population treated with a control compound.

In some embodiments, modulation of OTC, CPS1, NAGS, ASS1, ARG1, SLC25A15, or SLC25A13 expression is an increase in OTC, CPS1, NAGS, ASS1, ARG1, SLC25A15, or SLC25A13 expression in a cell or a subject. In some embodiments, compositions and methods of the present invention cause an increase in the expression of a OTC, CPS1, NAGS, ASS1, ARG1, SLC25A15, or SLC25A13 gene as measured in a cell-based assay of cells exposed to the compound at a level corresponding to the plasma level achieved at steady state in a subject dosed with the effective amount as compared to cells exposed to a placebo.

In some embodiments, the increase is determined in a population of test subjects and the amount of increase is determined by reference to a matched control population. In some embodiments, the increase is determined in a population of test subjects and the amount of reduction is determined by reference to a pre-treatment baseline measurement. In some embodiments, the increase is determined in a population of cells and the amount of increase is determined by reference to a matched control cell population.

In some embodiments, the urea cycle gene mutation status of the subject is or has been determined by a direct to consumer genetic test. Such tests are commercially available from multiple vendors, including, but not limited to, 23andMe, Ancestry.com, Futura Genetics, MyDNA, Pathway Genomics, Progenity, and Dante Labs.

In some embodiments, the urea cycle gene mutation status of the subject is or has been determined by a physician or healthcare provider ordered genetic test. Such tests can be provided by multiple vendors such as university internal labs, or a variety of established CLIA certified vendors, including but not limited to Invivoscribe, Cancer Genetics, Foundation Medicine, Centogene, and Quest Diagnostics.

IV. Formulations and Delivery

Pharmaceutical Compositions

Compositions of active ingredients may be prepared as pharmaceutical compositions. It will be understood that such compositions necessarily comprise one or more active ingredients and, most often, a pharmaceutically acceptable excipient.

Relative amounts of the active ingredient, a pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the pharmaceutical compositions described herein may comprise at least one payload. As a non-limiting example, the pharmaceutical compositions may contain 1, 2, 3, 4 or 5 payloads.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, rats, birds, including commercially relevant birds such as poultry, chickens, ducks, geese, and/or turkeys.

In some embodiments, compositions are administered to humans, human patients or subjects.

Formulations

Formulations provided herein can include, without limitation, saline, liposomes, lipid nanoparticles, polymers, peptides, proteins, cells transfected with viral vectors (e.g., for transfer or transplantation into a subject) and combinations thereof.

Formulations of the pharmaceutical compositions described herein may be prepared by any method known or hereafter developed in the art of pharmacology. As used herein the term "pharmaceutical composition" refers to compositions comprising at least one active ingredient and optionally one or more pharmaceutically acceptable excipients.

In general, such preparatory methods include the step of associating the active ingredient with an excipient and/or one or more other accessory ingredients.

Formulations of the compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

Excipients and Diluents

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Excipients, as used herein, include, but are not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21st Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Inactive Ingredients

In some embodiments, the pharmaceutical compositions formulations may comprise at least one inactive ingredient. As used herein, the term "inactive ingredient" refers to one or more agents that do not contribute to the activity of the active ingredient of the pharmaceutical composition included in formulations. In some embodiments, all, none or some of the inactive ingredients which may be used in the formulations provided herein may be approved by the US Food and Drug Administration (FDA).

In one embodiment, the pharmaceutical compositions comprise at least one inactive ingredient such as, but not limited to, 1,2,6-Hexanetriol; 1,2-Dimyristoyl-Sn-Glycero-3-(Phospho-S-(1-Glycerol)); 1,2-Dimyristoyl-Sn-Glycero-3-Phosphocholine; 1,2-Dioleoyl-Sn-Glycero-3-Phosphocholine; 1,2-Dipalmitoyl-Sn-Glycero-3-(Phospho-Rac-(1-Glycerol)); 1,2-Distearoyl-Sn-Glycero-3-(Phospho-Rac-(1-Glycerol)); 1,2-Distearoyl-Sn-Glycero-3-Phosphocholine; 1-O-Tolylbiguanide; 2-Ethyl-1,6-Hexanediol; Acetic Acid; Acetic Acid, Glacial; Acetic Anhydride; Acetone; Acetone Sodium Bisulfite; Acetylated Lanolin Alcohols; Acetylated Monoglycerides; Acetylcysteine; Acetyltryptophan, DL-; Acrylates Copolymer; Acrylic Acid-Isooctyl Acrylate Copolymer; Acrylic Adhesive 788; Activated Charcoal; Adcote 72A103; Adhesive Tape; Adipic Acid; Aerotex Resin 3730; Alanine; Albumin Aggregated; Albumin Colloidal; Albumin Human; Alcohol; Alcohol, Dehydrated; Alcohol, Denatured; Alcohol, Diluted; Alfadex; Alginic Acid; Alkyl Ammonium Sulfonic Acid Betaine; Alkyl Aryl Sodium Sulfonate; Allantoin; Allyl .Alpha.-Ionone; Almond Oil; Alpha-Terpineol; Alpha-Tocopherol; Alpha-Tocopherol Acetate, Dl-; Alpha-Tocopherol, Dl-; Aluminum Acetate; Aluminum Chlorohydroxy Allantoinate; Aluminum Hydroxide; Aluminum Hydroxide-Sucrose, Hydrated; Aluminum Hydroxide Gel; Aluminum Hydroxide Gel F 500; Aluminum Hydroxide Gel F 5000; Aluminum Monostearate; Aluminum Oxide; Aluminum Polyester; Aluminum Silicate; Aluminum Starch Octenylsuccinate; Aluminum Stearate; Aluminum Subacetate; Aluminum Sulfate Anhydrous; Amerchol C; Amerchol-Cab; Aminomethylpropanol; Ammonia; Ammonia Solution; Ammonia Solution, Strong; Ammonium Acetate; Ammonium Hydroxide; Ammonium Lauryl Sulfate; Ammonium Nonoxynol-4 Sulfate; Ammonium Salt Of C-12-C-15 Linear Primary Alcohol Ethoxylate; Ammonium Sulfate; Ammonyx; Amphoteric-2; Amphoteric-9; Anethole; Anhydrous Citric Acid; Anhydrous Dextrose; Anhydrous Lactose; Anhydrous Trisodium Citrate; Aniseed Oil; Anoxid Sbn; Antifoam; Antipyrine; Apaflurane; Apricot Kernel Oil Peg-6 Esters; Aquaphor; Arginine; Arlacel; Ascorbic Acid; Ascorbyl Palmitate; Aspartic Acid; Balsam Peru; Barium Sulfate; Beeswax; Beeswax, Synthetic; Beheneth-10; Bentonite; Benzalkonium Chloride; Benzenesulfonic Acid; Benzethonium Chloride; Benzododecinium Bromide; Benzoic Acid; Benzyl Alcohol; Benzyl Benzoate; Benzyl Chloride; Betadex; Bibapcitide; Bismuth Subgallate; Boric Acid; Brocrinat; Butane; Butyl Alcohol; Butyl Ester Of Vinyl Methyl Ether/Maleic Anhydride Copolymer (125000 Mw); Butyl Stearate; Butylated Hydroxyanisole; Butylated Hydroxytoluene; Butylene Glycol; Butylparaben; Butyric Acid; C20-40 Pareth-24; Caffeine; Calcium; Calcium Carbonate; Calcium Chloride; Calcium Gluceptate; Calcium Hydroxide; Calcium Lactate; Calcobutrol; Caldiamide Sodium; Caloxetate Trisodium; Calteridol Calcium; Canada Balsam; Caprylic/Capric Triglyceride; Caprylic/Capric/Stearic Triglyceride; Captan; Captisol; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythritol Crosslinked); Carbomer Homopolymer Type C (Allyl Pentaerythritol Crosslinked); Carbon Dioxide; Carboxy Vinyl Copolymer; Carboxymethylcellulose; Carboxymethylcellulose Sodium; Carboxypolymethylene; Carrageenan; Carrageenan Salt; Castor Oil; Cedar Leaf Oil; Cellulose; Cellulose, Microcrystalline; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20; Ceteth-23; Cetostearyl Alcohol; Cetrimonium Chloride; Cetyl Alcohol; Cetyl Esters Wax; Cetyl Palmitate; Cetylpyridinium Chloride; Chlorobutanol; Chlorobutanol Hemihydrate; Chlorobutanol, Anhydrous; Chlorocresol; Chloroxylenol; Cholesterol; Choleth; Choleth-24; Citrate; Citric Acid; Citric Acid Monohydrate; Citric Acid, Hydrous; Cocamide Ether Sulfate; Cocamine Oxide; Coco Betaine; Coco Diethanolamide; Coco Monoethanolamide; Cocoa Butter; Coco-Glycerides; Coconut Oil; Coconut Oil, Hydrogenated; Coconut Oil/Palm Kernel Oil Glycerides, Hydrogenated; Cocoyl Caprylocaprate; Cola Nitida Seed Extract; Collagen; Coloring Suspension; Corn Oil; Cottonseed Oil; Cream Base; Creatine; Creatinine; Cresol; Croscarmellose Sodium; Crospovidone; Cupric Sulfate; Cupric Sulfate Anhydrous; Cyclomethicone; Cyclomethicone/Dimethicone Copolyol; Cysteine; Cysteine Hydrochloride; Cysteine Hydrochloride Anhydrous; Cysteine, Dl-; D&C Red No. 28; D&C Red No. 33; D&C Red No. 36; D&C Red No. 39; D&C Yellow No. 10; Dalfampridine; Daubert 1-5 Pestr (Matte) 164z; Decyl Methyl Sulfoxide; Dehydag Wax Sx; Dehydroacetic Acid; Dehymuls E; Denatonium Benzoate; Deoxycholic Acid; Dextran; Dextran 40; Dextrin; Dextrose; Dextrose Monohydrate; Dextrose Solution; Diatrizoic Acid; Diazolidinyl Urea; Dichlorobenzyl Alcohol; Dichlorodifluoromethane; Dichlorotetrafluoroethane; Diethanolamine; Diethyl Pyrocarbonate; Diethyl Sebacate; Diethylene Glycol Monoethyl Ether; Diethylhexyl Phthalate; Dihydroxyaluminum Aminoacetate; Diisopropanolamine; Diisopropyl Adipate; Diisopropyl Dilinoleate; Dimethicone 350; Dimethicone Copolyol; Dimethicone Mdx4-4210; Dimethicone Medical Fluid 360; Dimethyl Isosorbide; Dimethyl Sulfoxide; Dimethylaminoethyl Methacrylate-Butyl Methacrylate-Methyl Methacrylate Copolymer; Dimethyldioctadecylammonium Bentonite; Dimethylsiloxane/Methylvinylsiloxane Copolymer; Dinoseb Ammonium Salt; Dipalmitoylphosphatidylglycerol, Dl-; Dipropylene Glycol; Disodium Cocoamphodiacetate; Disodium Laureth Sulfosuccinate; Disodium Lauryl Sulfosuccinate; Disodium Sulfosalicylate; Disofenin; Divinylbenzene Styrene Copolymer; Dmdm Hydantoin; Docosanol; Docusate Sodium; Duro-Tak 280-2516; Duro-Tak 387-2516; Duro-Tak 80-1196; Duro-Tak 87-2070; Duro-Tak 87-2194; Duro-Tak 87-2287; Duro-Tak 87-2296; Duro-Tak 87-2888; Duro-Tak 87-2979; Edetate Calcium Disodium; Edetate Disodium; Edetate Disodium Anhydrous; Edetate Sodium; Edetic Acid; Egg Phospholipids; Entsufon; Entsufon Sodium; Epilactose; Epitetracycline Hydrochloride; Essence Bouquet 9200; Ethanolamine Hydrochloride; Ethyl Acetate; Ethyl Oleate; Ethylcelluloses; Ethylene Glycol; Ethylene Vinyl Acetate Copolymer; Ethylenediamine; Ethylenediamine Dihydrochloride; Ethylene-Propylene Copolymer; Ethylene-Vinyl Acetate Copolymer (28% Vinyl Acetate); Ethylene-Vinyl Acetate Copolymer (9% Vinylacetate); Ethylhexyl Hydroxystearate; Ethylparaben; Eucalyptol; Exametazime; Fat, Edible; Fat, Hard; Fatty Acid Esters; Fatty Acid Pentaerythriol Ester; Fatty Acids; Fatty Alcohol Citrate; Fatty Alcohols; Fd&C Blue No. 1; Fd&C Green No. 3; Fd&C Red No. 4; Fd&C Red No. 40; Fd&C Yellow No. 10 (Delisted); Fd&C Yellow No. 5; Fd&C Yellow No. 6; Ferric Chloride; Ferric Oxide; Flavor 89-186; Flavor 89-259; Flavor Df-119; Flavor Df-1530; Flavor Enhancer; Flavor Fig 827118; Flavor Raspberry Pfc-8407; Flavor Rhodia Pharmaceutical No. Rf 451; Fluorochlorohydrocarbons; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124; Fragrance Bouquet 10328; Fragrance Chemoderm 6401-B; Fragrance Chemoderm 6411; Fragrance Cream No. 73457; Fragrance Cs-28197; Fragrance Felton 066m; Fragrance Firmenich 47373; Fragrance Givaudan Ess 9090/1c; Fragrance H-6540; Fragrance Herbal 10396; Fragrance Nj-1085; Fragrance P O F1-147; Fragrance Pa 52805; Fragrance Pera Derm D; Fragrance Rbd-9819; Fragrance Shaw Mudge U-7776; Fragrance Tf 044078; Fragrance Ungerer Honeysuckle K 2771; Fragrance Ungerer N5195; Fructose; Gadolinium Oxide; Galactose; Gamma Cyclodextrin; Gelatin; Gelatin, Crosslinked; Gelfoam Sponge; Gellan Gum (Low Acyl); Gelva 737; Gentisic Acid; Gentisic Acid Ethanolamide; Gluceptate Sodium; Gluceptate Sodium Dihydrate; Gluconolactone; Glucuronic Acid; Glutamic Acid, Dl-; Glutathione; Glycerin; Glycerol Ester Of Hydrogenated Rosin; Glyceryl Citrate; Glyceryl Isostearate; Glyceryl Laurate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate-Laureth-23; Glyceryl Stearate/Peg Stearate; Glyceryl Stearate/Peg-100 Stearate; Glyceryl Stearate/Peg-40 Stearate; Glyceryl Stearate-Stearamidoethyl Diethylamine; Glyceryl Trioleate; Glycine; Glycine Hydrochloride; Glycol Distearate; Glycol Stearate; Guanidine Hydrochloride; Guar Gum; Hair Conditioner (18n195-1m); Heptane; Hetastarch; Hexylene Glycol; High Density Polyethylene; Histidine; Human Albumin Microspheres; Hyaluronate Sodium; Hydrocarbon; Hydrocarbon Gel, Plasticized; Hydrochloric Acid; Hydrochloric Acid, Diluted; Hydrocortisone; Hydrogel Polymer; Hydrogen Peroxide; Hydrogenated Castor Oil; Hydrogenated Palm Oil; Hydrogenated Palm/Palm Kernel Oil Peg-6 Esters; Hydrogenated Polybutene 635-690; Hydroxide Ion; Hydroxyethyl Cellulose; Hydroxyethylpiperazine Ethane Sulfonic Acid; Hydroxymethyl Cellulose; Hydroxyoctacosanyl Hydroxystearate; Hydroxypropyl Cellulose; Hydroxypropyl Methylcellulose 2906; Hydroxypropyl-Beta-cyclodextrin; Hypromellose 2208 (15000 Mpa·S); Hypromellose 2910 (15000 Mpa·S); Hypromelloses; Imidurea; Iodine; Iodoxamic Acid; Iofetamine Hydrochloride; Irish Moss Extract; Isobutane; Isoceteth-20; Isoleucine; Isooctyl Acrylate; Isopropyl Alcohol; Isopropyl Isostearate; Isopropyl Myristate; Isopropyl Myristate—Myristyl Alcohol; Isopropyl Palmitate; Isopropyl Stearate; Isostearic Acid; Isostearyl Alcohol; Isotonic Sodium Chloride Solution; Jelene; Kaolin; Kathon Cg; Kathon Cg II; Lactate; Lactic Acid; Lactic Acid, Dl-; Lactic Acid, L-; Lactobionic Acid; Lactose; Lactose Monohydrate; Lactose, Hydrous; Laneth; Lanolin; Lanolin Alcohol—Mineral Oil; Lanolin Alcohols; Lanolin Anhydrous; Lanolin Cholesterols; Lanolin Nonionic Derivatives; Lanolin, Ethoxylated; Lanolin, Hydrogenated; Lauralkonium Chloride; Lauramine Oxide; Laurdimonium Hydrolyzed Animal Collagen; Laureth Sulfate; Laureth-2; Laureth-23; Laureth-4; Lauric Diethanolamide; Lauric Myristic Diethanolamide; Lauroyl Sarcosine; Lauryl Lactate; Lauryl Sulfate; *Lavandula angustifolia* Flowering Top; Lecithin; Lecithin Unbleached; Lecithin, Egg; Lecithin, Hydrogenated; Lecithin, Hydrogenated Soy; Lecithin, Soybean; Lemon Oil; Leucine; Levulinic Acid; Lidofenin; Light Mineral Oil; Light Mineral Oil (85 Ssu); Limonene, (+/−)-; Lipocol Sc-15; Lysine; Lysine Acetate; Lysine Monohydrate; Magnesium Aluminum Silicate; Magnesium Aluminum Silicate Hydrate; Magnesium Chloride; Magnesium Nitrate; Magnesium Stearate; Maleic Acid; Mannitol; Maprofix; Mebrofenin; Medical Adhesive Modified S-15; Medical Antiform A-F Emulsion; Medronate Disodium; Medronic Acid; Meglumine; Menthol; Metacresol; Metaphosphoric Acid; Methanesulfonic Acid; Methionine; Methyl Alcohol; Methyl Gluceth-10; Methyl Gluceth-20; Methyl Gluceth-20 Sesquistearate; Methyl Glucose Sesquistearate; Methyl Laurate; Methyl Pyrrolidone; Methyl Salicylate; Methyl Stearate; Methylboronic Acid; Methylcellulose (4000 Mpa·S); Methylcelluloses; Methylchloroisothiazolinone; Methylene Blue; Methylisothiazolinone; Methylparaben; Microcrystalline Wax; Mineral Oil; Mono And Diglyceride; Monostearyl Citrate; Monothioglycerol; Multisterol Extract; Myristyl Alcohol; Myristyl Lactate; Myristyl-.Gamma.-Picolinium Chloride; N-(Carbamoyl-Methoxy Peg-40)-1,2-Distearoyl-Cephalin Sodium; N,N-Dimethylacetamide; Niacinamide; Nioxime; Nitric Acid; Nitrogen; Nonoxynol Iodine; Nonoxynol-15; Nonoxynol-9; Norflurane; Oatmeal; Octadecene-1/Maleic Acid Copolymer; Octanoic Acid; Octisalate; Octoxynol-1; Octoxynol-40; Octoxynol-9; Octyldodecanol; Octylphenol Polymethylene; Oleic Acid; Oleth-10/Oleth-5; Oleth-2; Oleth-20; Oleyl Alcohol; Oleyl Oleate; Olive Oil; Oxidronate Disodium; Oxyquinoline; Palm Kernel Oil; Palmitamine Oxide; Parabens; Paraffin; Paraffin, White Soft; Parfum Creme 45/3; Peanut Oil; Peanut Oil, Refined; Pectin; Peg 6-32 Stearate/Glycol Stearate; Peg Vegetable Oil; Peg-100 Stearate; Peg-12 Glyceryl Laurate; Peg-120 Glyceryl Stearate; Peg-120 Methyl Glucose Dioleate; Peg-15 Cocamine; Peg-150 Distearate; Peg-2 Stearate; Peg-20 Sorbitan Isostearate; Peg-22 Methyl Ether/Dodecyl Glycol Copolymer; Peg-25 Propylene Glycol Stearate; Peg-4 Dilaurate; Peg-4 Laurate; Peg-40 Castor Oil; Peg-40 Sorbitan Diisostearate; Peg-45/Dodecyl Glycol Copolymer; Peg-5 Oleate; Peg-50 Stearate; Peg-54 Hydrogenated Castor Oil; Peg-6 Isostearate; Peg-60 Castor Oil; Peg-60 Hydrogenated Castor Oil; Peg-7 Methyl Ether; Peg-75 Lanolin; Peg-8 Laurate; Peg-8 Stearate; Pegoxol 7 Stearate; Pentadecalactone; Pentaerythritol Cocoate; Pentasodium Pentetate; Pentetate Calcium Trisodium; Pentetic Acid; Peppermint Oil; Perflutren; Perfume 25677; Perfume Bouquet; Perfume E-1991; Perfume Gd 5604; Perfume Tana 90/42 Scba; Perfume W-1952-1; Petrolatum; Petrolatum, White; Petroleum Distillates; Phenol; Phenol, Liquefied; Phenonip; Phenoxyethanol; Phenylalanine; Phenylethyl Alcohol; Phenylmercuric Acetate; Phenylmercuric Nitrate; Phosphatidyl Glycerol, Egg; Phospholipid; Phospholipid, Egg; Phospholipon 90g; Phosphoric Acid; Pine Needle Oil (*Pinus sylvestris*); Piperazine Hexahydrate; Plastibase-50w; Polacrilin; Polidronium Chloride; Poloxamer 124; Poloxamer 181; Poloxamer 182; Poloxamer 188; Poloxamer 237; Poloxamer 407; Poly(Bis(P-Carboxyphenoxy)Propane Anhydride): Sebacic Acid; Poly(Dimethylsiloxane/Methylvinylsiloxane/Methylhydrogensiloxane) Dimethylvinyl Or Dimethylhydroxy Or Trimethyl Endblocked; Poly(Dl-Lactic-Co-Glycolic Acid), (50:50; Poly(Dl-Lactic-Co-Glycolic Acid), Ethyl Ester Terminated, (50:50; Polyacrylic Acid (250000 Mw); Polybutene (1400 Mw); Polycarbophil; Polyester; Polyester Polyamine Copolymer; Polyester Rayon; Polyethylene Glycol 1000; Polyethylene Glycol 1450; Polyethylene Glycol 1500; Polyethylene Glycol 1540; Polyethylene Glycol 200; Polyethylene Glycol 300; Polyethylene Glycol 300-1600; Polyethylene Glycol 3350; Polyethylene Glycol 400; Polyethylene Glycol 4000; Polyethylene Glycol 540; Polyethylene Glycol 600; Polyethylene Glycol 6000; Polyethylene Glycol 8000; Polyethylene Glycol 900; Polyethylene High Density Containing Ferric Oxide Black (<1%); Polyethylene Low Density Containing Barium Sulfate (20-24%); Polyethylene T; Polyethylene Terephthalates; Polyglactin; Polyglyceryl-3 Oleate; Polyglyceryl-4 Oleate; Polyhydroxyethyl Methacrylate; Polyisobutylene; Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polylactide; Polyols; Polyoxyethylene-Polyoxypropylene 1800; Polyoxyethylene Alcohols; Polyoxyethylene Fatty Acid Esters; Polyoxyethylene Propylene; Polyoxyl 20 Cetostearyl Ether; Polyoxyl 35 Castor Oil; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate; Polyoxyl Lanolin; Polyoxyl Palmitate; Polyoxyl Stearate; Polypropylene; Polypropylene Glycol; Polyquaternium-10; Polyquaternium-7 (70/30 Acrylamide/Dadmac; Polysiloxane; Polysorbate 20; Polysorbate 40; Polysorbate 60; Polysorbate 65; Polysorbate 80; Polyurethane; Polyvinyl Acetate; Polyvinyl Alcohol; Polyvinyl Chloride; Polyvinyl Chloride-Polyvinyl Acetate Copolymer; Polyvinylpyridine; Poppy Seed Oil; Potash; Potassium Acetate; Potassium Alum; Potassium Bicarbonate; Potassium Bisulfite; Potassium Chloride; Potassium Citrate; Potassium Hydroxide; Potassium Metabisulfite; Potassium Phosphate, Dibasic; Potassium Phosphate, Monobasic; Potassium Soap; Potassium Sorbate; Povidone Acrylate Copolymer; Povidone Hydrogel; Povidone K17; Povidone K25; Povidone K29/32; Povidone K30; Povidone K90; Povidone K90f; Povidone/Eicosene Copolymer; Povidones; Ppg-12/Smdi Copolymer; Ppg-15 Stearyl Ether; Ppg-20 Methyl Glucose Ether Distearate; Ppg-26 Oleate; Product Wat; Proline; Promulgen D; Promulgen G; Propane; Propellant A-46; Propyl Gallate; Propylene Carbonate; Propylene Glycol; Propylene Glycol Diacetate; Propylene Glycol Dicaprylate; Propylene Glycol Monolaurate; Propylene Glycol Monopalmitostearate; Propylene Glycol Palmitostearate; Propylene Glycol Ricinoleate; Propylene Glycol/Diazolidinyl Urea/Methylparaben/Propylparben; Propylparaben; Protamine Sulfate; Protein Hydrolysate; Pvm/Ma Copolymer; Quaternium-15; Quaternium-15 Cis-Form; Quaternium-52; Ra-2397; Ra-3011; Saccharin; Saccharin Sodium; Saccharin Sodium Anhydrous; Safflower Oil; Sd Alcohol 3a; Sd Alcohol 40; Sd Alcohol 40-2; Sd Alcohol 40b; Sepineo P 600; Serine; Sesame Oil; Shea Butter; Silastic Brand Medical Grade Tubing; Silastic Medical Adhesive, Silicone Type A; Silica, Dental; Silicon; Silicon Dioxide; Silicon Dioxide, Colloidal; Silicone; Silicone Adhesive 4102; Silicone Adhesive 4502; Silicone Adhesive Bio-Psa Q7-4201; Silicone Adhesive Bio-Psa Q7-4301; Silicone Emulsion; Silicone/Polyester Film Strip; Simethicone; Simethicone Emulsion; Sipon Ls 20np; Soda Ash; Sodium Acetate; Sodium Acetate Anhydrous; Sodium Alkyl Sulfate; Sodium Ascorbate; Sodium Benzoate; Sodium Bicarbonate; Sodium Bisulfate; Sodium Bisulfite; Sodium Borate; Sodium Borate Decahydrate; Sodium Carbonate; Sodium Carbonate Decahydrate; Sodium Carbonate Monohydrate; Sodium Cetostearyl Sulfate; Sodium Chlorate; Sodium Chloride; Sodium Chloride Injection; Sodium Chloride Injection, Bacteriostatic; Sodium Cholesteryl Sulfate; Sodium Citrate; Sodium Cocoyl Sarcosinate; Sodium Desoxycholate; Sodium Dithionite; Sodium Dodecylbenzenesulfonate; Sodium Formaldehyde Sulfoxylate; Sodium Gluconate; Sodium Hydroxide; Sodium Hypochlorite; Sodium Iodide; Sodium Lactate; Sodium Lactate, L-; Sodium Laureth-2 Sulfate; Sodium Laureth-3 Sulfate; Sodium Laureth-5 Sulfate; Sodium Lauroyl Sarcosinate; Sodium Lauryl Sulfate; Sodium Lauryl Sulfoacetate; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Dodecahydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Polyacrylate (2500000 Mw); Sodium Pyrophosphate; Sodium Pyrrolidone Carboxylate; Sodium Starch Glycolate; Sodium Succinate Hexahydrate; Sodium Sulfate; Sodium Sulfate Anhydrous; Sodium Sulfate Decahydrate; Sodium Sulfite; Sodium Sulfosuccinated Undecyclenic Monoalkylolamide; Sodium Tartrate; Sodium Thioglycolate; Sodium Thiomalate; Sodium Thiosulfate; Sodium Thiosulfate Anhydrous; Sodium Trimetaphosphate; Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Trioleate; Sorbitan Tristearate; Sorbitol; Sorbitol Solution; Soybean Flour; Soybean Oil; Spearmint Oil; Spermaceti; Squalane; Stabilized Oxychloro Complex; Stannous 2-Ethylhexanoate; Stannous Chloride; Stannous Chloride Anhydrous; Stannous Fluoride; Stannous Tartrate; Starch; Starch 1500, Pregelatinized; Starch, Corn; Stearalkonium Chloride; Stearalkonium Hectorite/Propylene Carbonate; Stearamidoethyl Diethylamine; Steareth-10; Steareth-100; Steareth-2; Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Sterile Water For Inhalation; Styrene/Isoprene/Styrene Block Copolymer; Succimer; Succinic Acid; Sucralose; Sucrose; Sucrose Distearate; Sucrose Polyesters; Sulfacetamide Sodium; Sulfobutylether .Beta.-Cyclodextrin; Sulfur Dioxide; Sulfuric Acid; Sulfurous Acid; Surfactol Qs; Tagatose, D-; Talc; Tall Oil; Tallow Glycerides; Tartaric Acid; Tartaric Acid, Dl-; Tenox; Tenox-2; Tert-Butyl Alcohol; Tert-Butyl Hydroperoxide; Tert-Butylhydroquinone; Tetrakis(2-Methoxyisobutylisocyanide)Copper(I) Tetrafluoroborate; Tetrapropyl Orthosilicate; Tetrofosmin; Theophylline; Thimerosal; Threonine; Thymol; Tin; Titanium Dioxide; Tocopherol; Tocophersolan; Total parenteral nutrition, lipid emulsion; Triacetin; Tricaprylin; Trichloromonofluoromethane; Trideceth-10; Triethanolamine Lauryl Sulfate; Trifluoroacetic Acid; Triglycerides, Medium Chain; Trihydroxystearin; Trilaneth-4 Phosphate; Trilaureth-4 Phosphate; Trisodium Citrate Dihydrate; Trisodium Hedta; Triton 720; Triton X-200; Trolamine; Tromantadine; Tromethamine (TRIS); Tryptophan; Tyloxapol; Tyrosine; Undecylenic Acid; Union 76 Amsco-Res 6038; Urea; Valine; Vegetable Oil; Vegetable Oil Glyceride, Hydrogenated; Vegetable Oil, Hydrogenated; Versetamide; Viscarin; Viscose/Cotton; Vitamin E; Wax, Emulsifying; Wecobee Fs; White Ceresin Wax; White Wax; Xanthan Gum; Zinc; Zinc Acetate; Zinc Carbonate; Zinc Chloride; and Zinc Oxide.

Pharmaceutical composition formulations disclosed herein may include cations or anions. In one embodiment, the formulations include metal cations such as, but not limited to, Zn2+, Ca2+, Cu2+, Mn2+, Mg+ and combinations thereof. As a non-limiting example, formulations may include polymers and complexes with a metal cation (See e.g., U.S. Pat. Nos. 6,265,389 and 6,555,525, each of which is herein incorporated by reference in its entirety).

Formulations may also include one or more pharmaceutically acceptable salts. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids.

Solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

V. Administration and Dosing

Administration

The terms "administering" and "introducing" are used interchangeably herein and refer to the delivery of the pharmaceutical composition into a cell or a subject. In the case of delivery to a subject, the pharmaceutical composition is delivered by a method or route that results in at least partial localization of the introduced cells at a desired site, such as hepatocytes, such that a desired effect(s) is produced.

In one aspect of the method, the pharmaceutical composition may be administered via a route such as, but not limited to, enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

Modes of administration include injection, infusion, instillation, and/or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

In some embodiments, compounds provided herein can be administered to cells systemically. The phrases "systemic administration," "administered systemically," "peripheral administration," and "administered peripherally" refer to the administration other than directly into a target site, tissue, or organ, such that it enters, instead, the subject's circulatory system and, thus, is subject to metabolism and other like processes. In other embodiments, compounds provided herein can be administered to cells ex vivo, i.e., the compounds can be administered to cells that have been removed from an organ or tissue and held outside the subject's body e.g., in primary culture.

Dosing

The term "effective amount" refers to the amount of the active ingredient needed to prevent or alleviate at least one or more signs or symptoms of a specific disease and/or condition, and relates to a sufficient amount of a composition to provide the desired effect. The term "therapeutically effective amount" therefore refers to an amount of active ingredient or a composition comprising the active ingredient that is sufficient to promote a particular effect when administered to a typical subject. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

The pharmaceutical, diagnostic, or prophylactic compositions provided herein may be administered to a subject using any amount and any route of administration effective for preventing, treating, managing, or diagnosing diseases, disorders and/or conditions. The exact amount required will vary from subject to subject, depending on the species, age, and general condition of the subject, the severity of the disease, the particular composition, its mode of administration, its mode of activity, and the like. The subject may be a human, a mammal, or an animal. Compositions are typically formulated in unit dosage form for ease of administration and uniformity of dosage. It will be understood, however, that the total daily usage of the compositions provided herein may be decided by the attending physician within the scope of sound medical judgment. The specific therapeutically effective, prophylactically effective, or appropriate diagnostic dose level for any particular individual will depend upon a variety of factors including the disorder being treated and the severity of the disorder; the activity of the specific payload employed; the specific composition employed; the age, body weight, general health, sex and diet of the patient; the time of administration, and route of administration; the duration of the treatment; drugs used in combination or coincidental with the active ingredient; and like factors well known in the medical arts.

In certain embodiments, pharmaceutical compositions may be administered at dosage levels sufficient to deliver from about 0.01 mg/kg to about 100 mg/kg, from about 0.01 mg/kg to about 0.05 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, or prophylactic, effect.

The desired dosage of the composition may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event.

VI. Additional Embodiments

A method for increasing OTC gene expression in a cell harboring an OTC mutation associated with a partial reduction of OTC function, comprising: contacting the cell with an effective amount of a compound that inhibits a target selected from the group consisting of JAK1, JAK2, JAK3, HSP90, MAPK, EGFR, FGFR, BRAF, RAF1, KDR, FLT1, TBK1, IKBKE, PRKAA1, PRKAA2, PRKAB1, BMPR1A, BMPR1B, FAK, and HIF1a.

The method of the above embodiment, wherein the cell is a hepatocyte.

The method of the above embodiment, wherein the target is JAK1, JAK2 and JAK3 and the compound selected from the group consisting of Momelotinib and Baricitinib.

The method of the above embodiment, wherein the compound is Momelotinib.

The method of the above embodiment, wherein the compound is Baricitinib.

The method of the above embodiments, wherein the target is HSP90 and the compound is selected from the group consisting of 17-AAG, BIIB021, HSP-990, and Retaspimycin HCl.

The method of the above embodiments, wherein the target is MAPK and the compound is selected from the group consisting of BIRB796, Pamapimod and PH-797804.

The method of the above embodiments, wherein the target is EGFR and the compound is Mubritinib (TAK 165).

The method of the above embodiments, wherein the target is FGFR and the compound is XL228.

The method of the above embodiments, wherein the target is BRAF or RAF1 and the compound is selected from the group consisting of Lifirafenib (BGB-283) and BMS-214662.

The method of the above embodiments, wherein the target is KDR or FLT1 and the compound is Foretinib/XL880 (GSK1363089).

The method of the above embodiments, wherein the target is TBK1 or IKBKE and the compound is BX795.

The method of the above embodiments, wherein the target is PRKAA1, PRKAA2, or PRKAB1 and the compound is Dorsomorphin.

The method of the above embodiments, wherein the target is FAK and the compound is PF-00562271.

The method of the above embodiments, wherein the target is HIF1a and the compound is BAY 87-2243.

A method for increasing OTC gene expression in a cell harboring an OTC mutation associated with a partial reduction of OTC function, comprising: contacting the cell with an siRNA compound that inhibits a target selected from the group consisting of JAK1, WSTR1, YAP1, CSF1R, LYN, SMAD3, NTRK1, EPHB3, EPHB4, FGFR4, INSR, KDR, FLT1, FGFR2, EPHB2, PDGFRB, IRF5, FGFR1, EPHB1, FYN, FLT4, YY1, IRF1, IGF-1, SMAD1, DDR1, HSP90AA1, and SMAD2.

A method for increasing OTC expression in a human subject harboring an OTC mutation associated with a partial reduction of OTC function, comprising: administering to the subject an effective amount of a compound that inhibits a target selected from the group consisting of JAK1, JAK2, JAK3, HSP90, MAPK, EGFR, FGFR, BRAF, RAF1, KDR, FLT1, TBK1, IKBKE, PRKAA1, PRKAA2, PRKAB1, BMPR1A, BMPR1B, FAK, and HIF1a.

The method of the above embodiments, wherein the target is JAK1, JAK2 or JAK3 and the compound selected from the group consisting of Momelotinib and Baricitinib.

The method of the above embodiments, wherein the compound is Momelotinib.

The method of the above embodiments, wherein the compound is Baricitinib.

The method of the above embodiments, wherein the target is HSP90 and the compound is selected from the group consisting of 17-AAG, BIIB021, HSP-990, and Retaspimycin HCl.

The method of the above embodiments, wherein the target is MAPK and the compound is selected from the group consisting of BIRB796, Pamapimod and PH-797804.

The method of the above embodiments, wherein the target is EGFR and the compound is Mubritinib (TAK 165).

The method of the above embodiments, wherein the target is FGFR and the compound is XL228.

The method of the above embodiments, wherein the target is BRAF or RAF1 and the compound is selected from the group consisting of Lifirafenib (BGB-283) and BMS-214662.

The method of the above embodiments, wherein the target is KDR or FLT1 and the compound is Foretinib/XL880 (GSK1363089).

The method of the above embodiments, wherein the target is TBK1 or IKBKE and the compound is BX795.

The method of the above embodiments, wherein the target is PRKAA1, PRKAA2, or PRKAB1 and the compound is Dorsomorphin.

The method of the above embodiments, wherein the target is FAK and the compound is PF-00562271.

The method of the above embodiments, wherein the target is HIF1a and the compound is BAY 87-2243.

The method of the above embodiments wherein the OTC mutation is selected from the group consisting of the mutations appearing in Table 20 that are associated with non-zero percent enzyme activity.

A method for increasing CPS1 gene expression in a cell harboring a CPS1 mutation associated with a partial reduction of CPS1 function, comprising: contacting the cell with an effective amount of a compound that inhibits a target selected from the group consisting of JAK1, JAK2, JAK3, HSP90, MAPK, EGFR, FGFR, ABL, FAK, and HIF1a.

The method of the above embodiments, wherein the cell is a hepatocyte.

The method of the above embodiments, wherein the target is JAK1, JAK2 and JAK3 and the compound selected from the group consisting of Momelotinib and Baricitinib.

The method of the above embodiments, wherein the target is HSP90 and the compound is selected from the group consisting of 17-AAG, BIIB021, HSP-990, and Retaspimycin HCl.

The method of the above embodiments, wherein the target is MAPK and the compound is selected from the group consisting of BIRB796, Pamapimod and PH-797804.

The method of the above embodiments, wherein the target is EGFR and the compound is Mubritinib (TAK 165).

The method of the above embodiments, wherein the target is ABL and the compound is Dasatinib.

The method of the above embodiments, wherein the target is FAK and the compound is PF-00562271.

The method of the above embodiments, wherein the target is HIF1a and the compound is BAY 87-2243.

A method for increasing CPS1 expression in a human subject harboring a CPS1 mutation associated with a partial reduction of CPS1 function, comprising: administering to the subject an effective amount of a compound that inhibits a target selected from the group consisting of JAK1, JAK2, JAK3, HSP90, MAPK, EGFR, FGFR, ABL, HER2, or HIF1a.

A method for increasing NAGS gene expression in a cell harboring a NAGS mutation associated with a partial reduction of NAGS function, comprising: contacting the cell with an siRNA compound that inhibits a target selected from the group consisting of mTOR, PI3K, and AKT.

The method of the above embodiments, wherein the cell is a hepatocyte.

The method of the above embodiments, wherein the target is mTOR and the compound is selected from the group consisting of OSI-027, CZ415, and AZD8055.

A method for increasing NAGS expression in a human subject harboring an NAGS mutation associated with a partial reduction of NAGS function, comprising: administering to the subject an effective amount of a compound that inhibits a target selected from the group consisting of mTOR, PI3K, and AKT.

A method for increasing SLC25A13 gene expression in a cell harboring an SLC25A13 mutation associated with a partial reduction of citrin function, comprising: contacting the cell with an siRNA compound that inhibits a target selected from the group consisting of mTOR, BRAF, or RAF1.

The method of the above embodiments, wherein the cell is a hepatocyte.

The method of the above embodiments, wherein the target is BRAF or RAF1 and the compound is selected from the group consisting of Lifirafenib (BGB-283) and BMS-214662.

The method of the above embodiments, wherein the target is mTOR and the compound is OSI-027.

A method for increasing SLC25A15 expression in a human subject harboring an SLC25A15 mutation associated with a partial reduction of ORNT1 function, comprising: administering to the subject an effective amount of a compound that inhibits a target selected from the group consisting of JAK1, JAK2, JAK3, ABL, PDGFR, EGFR, FGFR, BRAF, RAF1, HER2, HIF1a, Aurora A or Aurora B.

The method of the above embodiments, wherein the cell is a hepatocyte.

The method of the above embodiments, wherein the target is JAK1, JAK2 and JAK3 and the compound selected from the group consisting of Momelotinib, Baricitinib, and AT9283.

The method of the above embodiments, wherein the target is ABL and the compound is Dasatinib.

The method of the above embodiments, wherein the target is PDGFR and the compound is Crenolanib.

The method of the above embodiments, wherein the target is EGFR and the compound is Mubritinib (TAK 165).

The method of the above embodiments, wherein the target is FGFR and the compound is XL228.

The method of the above embodiments, wherein the target is FAK and the compound is PF-00562271.

The method of the above embodiments, wherein the target is HIF1a and the compound is BAY 87-2243 or Echinomycin.

The method of the above embodiments, wherein the target is Aurora A or Aurora B and the compound is PF-3814735.

A method for increasing SLC25A15 expression in a human subject harboring an SLC25A15 mutation associated with a partial reduction of ORNT1 function, comprising: administering to the subject an effective amount of a compound that inhibits a target selected from the group consisting of JAK1, JAK2, JAK3, ABL, PDGFR, EGFR, FGFR, BRAF, RAF1, HER2, HIF1a, Aurora A or Aurora B.

A method for increasing ASL gene expression in a cell harboring an ASL mutation associated with a partial reduction of ASL function, comprising: contacting the cell with an siRNA compound that inhibits a target selected from the group consisting of PDGFR, HIF1a, and FAK.

The method of the above embodiments, wherein the cell is a hepatocyte.

The method of the above embodiments, wherein the target is PDGFR and the compound is Crenolanib.

The method of the above embodiments, wherein the target is HIF1a and the compound is BAY 87-2243 or Echinomycin.

The method of the above embodiments, wherein the target is FAK and the compound is PF-00562271.

A method for increasing ASL expression in a human subject harboring an ASL mutation associated with a partial reduction of ASL function, comprising: administering to the subject an effective amount of a compound that inhibits a target selected from the group consisting of PDGFR, HIF1a, and FAK.

VII. Definitions

The term "analog," as used herein, refers to a compound that is structurally related to the reference compound and shares a common functional activity with the reference compound.

The term "biologic," as used herein, refers to a medical product made from a variety of natural sources such as micro-organism, plant, animal, or human cells.

The term "boundary," as used herein, refers to a point, limit, or range indicating where a feature, element, or property ends or begins.

The term "compound," as used herein, refers to a single agent or a pharmaceutically acceptable salt thereof, or a bioactive agent or drug.

The term "derivative," as used herein, refers to a compound that differs in structure from the reference compound, but retains the essential properties of the reference molecule.

The term "downstream neighborhood gene," as used herein, refers to a gene downstream of primary neighborhood gene that may be located within the same insulated neighborhood as the primary neighborhood gene.

The term "drug," as used herein, refers to a substance other than food intended for use in the diagnosis, cure, alleviation, treatment, or prevention of disease and intended to affect the structure or any function of the body.

The term "enhancer," as used herein, refers to regulatory DNA sequences that, when bound by transcription factors, enhance the transcription of an associated gene.

The term "gene," as used herein, refers to a unit or segment of the genomic architecture of an organism, e.g., a chromosome. Genes may be coding or non-coding. Genes may be encoded as contiguous or non-contiguous polynucleotides. Genes may be DNA or RNA.

The term "genomic signaling center," i.e., a "signaling center," as used herein, refers to regions within insulated neighborhoods that include regions capable of binding context-specific combinatorial assemblies of signaling molecules/signaling proteins that participate in the regulation of the genes within that insulated neighborhood or among more than one insulated neighborhood.

The term "genomic system architecture," as used herein, refers to the organization of an individual's genome and includes chromosomes, topologically associating domains (TADs), and insulated neighborhoods.

The term "herbal preparation," as used herein, refers to herbal medicines that contain parts of plants, or other plant materials, or combinations as active ingredients.

The term "insulated neighborhood" (IN), as used herein, refers to chromosome structure formed by the looping of two interacting sites in the chromosome sequence that may comprise CCCTC-Binding factor (CTCF) co-occupied by cohesin and affect the expression of genes in the insulated neighborhood as well as those genes in the vicinity of the insulated neighborhoods.

The term "insulator," as used herein, refers to regulatory elements that block the ability of an enhancer to activate a gene when located between them and contribute to specific enhancer-gene interactions.

The term "master transcription factor," as used herein, refers to signaling molecules which alter, whether to increase or decrease, the transcription of a target gene, e.g., a neighborhood gene and establish cell-type specific enhancers. Master transcription factors recruit additional signaling proteins, such as other transcription factors to enhancers to form signaling centers.

The term "minimal insulated neighborhood," as used herein, refers to an insulated neighborhood having at least one neighborhood gene and associated regulatory sequence region or regions (RSRs) which facilitate the expression or repression of the neighborhood gene such as a promoter and/or enhancer and/or repressor regions, and the like.

The term "modulate," as used herein, refers to an alteration (e.g., increase or decrease) in the expression of the target gene and/or activity of the gene product.

The term "neighborhood gene," as used herein, refers to a gene localized within an insulated neighborhood.

The term "penetrance," as used herein, refers to the proportion of individuals carrying a particular variant of a gene (e.g., mutation, allele or generally a genotype, whether wild type or not) that also exhibits an associated trait (phenotype) of that variant gene and in some situations is measured as the proportion of individuals with the mutation who exhibit clinical symptoms thus existing on a continuum.

The term "polypeptide," as used herein, refers to a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long.

The term "primary neighborhood gene" as used herein, refers to a gene which is most commonly found within a specific insulated neighborhood along a chromosome.

The term "primary downstream boundary," as used herein, refers to the insulated neighborhood boundary located downstream of a primary neighborhood gene.

The term "primary upstream boundary," as used herein, refers to the insulated neighborhood boundary located upstream of a primary neighborhood gene.

The term "promoter" as used herein, refers to a DNA sequence that defines where transcription of a gene by RNA polymerase begins and defines the direction of transcription indicating which DNA strand will be transcribed.

The term "regulatory sequence regions," as used herein, include but are not limited to regions, sections or zones along a chromosome whereby interactions with signaling molecules occur in order to alter expression of a neighborhood gene.

The term "repressor," as used herein, refers to any protein that binds to DNA and therefore regulates the expression of genes by decreasing the rate of transcription.

The term "secondary downstream boundary," as used herein, refers to the downstream boundary of a secondary loop within a primary insulated neighborhood.

The term "secondary upstream boundary," as used herein, refers to the upstream boundary of a secondary loop within a primary insulated neighborhood.

The term "signaling center," as used herein, refers to a defined region of a living organism that interacts with a defined set of biomolecules, such as signaling proteins or signaling molecules (e.g., transcription factors) to regulate gene expression in a context-specific manner.

The term "signaling molecule," as used herein, refers to any entity, whether protein, nucleic acid (DNA or RNA), organic small molecule, lipid, sugar or other biomolecule, which interacts directly, or indirectly, with a regulatory sequence region on a chromosome.

The term "signaling transcription factor," as used herein, refers to signaling molecules which alter, whether to increase or decrease, the transcription of a target gene, e.g., a neighborhood gene and also act as cell-cell signaling molecules.

The term "small molecule," as used herein, refers to a low molecular weight drug, i.e. <5000 Daltons organic compound that may help regulate a biological process.

The terms "subject" and "patient" are used interchangeably herein and refer to an animal to whom treatment with the compositions is provided.

The term "super-enhancers," as used herein, refers to are large clusters of transcriptional enhancers that drive expression of genes that define cell identity.

The term "therapeutic agent," as used herein, refers to a substance that has the ability to cure a disease or ameliorate the symptoms of the disease.

The term "therapeutic or treatment outcome," as used herein, refers to any result or effect (whether positive, negative or null) which arises as a consequence of the perturbation of a GSC or GSN. Examples of therapeutic outcomes include, but are not limited to, improvement or amelioration of the unwanted or negative conditions associated with a disease or disorder, lessening of side effects or symptoms, cure of a disease or disorder, or any improvement associated with the perturbation of a GSC or GSN.

The term "topologically associating domains" (TADs), as used herein, refers to structures that represent a modular organization of the chromatin and have boundaries that are shared by the different cell types of an organism.

The term "transcription factors," as used herein, refers to signaling molecules which alter, whether to increase or decrease, the transcription of a target gene, e.g., a neighborhood gene.

The term "therapeutic or treatment liability," as used herein, refers to a feature or characteristic associated with a treatment or treatment regime which is unwanted, harmful or which mitigates the therapies positive outcomes. Examples of treatment liabilities include for example toxicity, poor half-life, poor bioavailability, lack of or loss of efficacy or pharmacokinetic or pharmacodynamic risks.

The term "upstream neighborhood gene," as used herein, refers to a gene upstream of a primary neighborhood gene that may be located within the same insulated neighborhood as the primary neighborhood gene.

The term "urea cycle disorder," as used herein, refers to any disorder that is caused by a defect or malfunction in the urea cycle.

The term "urea cycle-related gene," as used herein, refers to a gene whose gene product (e.g., RNA or protein) is involved in the urea cycle.

Described herein are compositions and methods for perturbation of genomic signaling centers (GSCs) or entire gene signaling networks (GSNs) for the treatment of urea cycle disorders (e.g., OTC deficiency). The details of one or more embodiments are set forth in the accompanying description below. Although any materials and methods similar or equivalent to those described herein can be used in the practice or testing provided herein, the preferred materials and methods are now described. Other features, objects and advantages will be apparent from the description. In the description, the singular forms also include the plural unless the context clearly dictates otherwise. Unless defined otherwise, all technical and scientific terms used herein have the same meaning as commonly understood by one of ordinary skill in the art. In the case of conflict, the present description will control.

VIII. Examples

Example 1. Experimental Procedures

A. Hepatocyte Cell Culture

Cryopreserved hepatocytes were cultured in plating media for 16 hours, transferred to maintenance media for 4 hours. Cultured on serum-free media for 2 hours, then a compound was added. The hepatocytes were maintained on the serum-free media for 16 hours prior to gene expression analysis. Primary Human Hepatocytes were stored in the vapor phase of a liquid nitrogen freezer (about −130° C.).

To seed the primary human hepatocytes, vials of cells were retrieved from the $LN_2$ freezer, thawed in a 37° C. water bath, and swirled gently until only a sliver of ice remained. Using a 10 ml serological pipet, cells were gently pipetted out of the vial and gently pipetted down the side of 50 mL conical tube containing 20 mL cold thaw medium. The vial was rinsed with about 1 mL of thaw medium, and the rinse was added to the conical tube. Up to 2 vials may be added to one tube of 20 mL thaw medium.

The conical tube(s) were gently inverted 2-3 times and centrifuged at 100 g for 10 minutes at 4° C. with reduced braking (e.g. 4 out of 9). The thaw medium slowly was slowly aspirated to avoid the pellet. 4 mL cold plating medium was added slowly down the side (8 mL if combined 2 vials to 1 tube), and the vial was inverted gently several times to resuspend cells.

Cells were kept on ice until 100 μl of well-mixed cells were added to 400 μl diluted Trypan blue and mixed by gentle inversion. They were counted using a hemocytometer (or Cellometer), and viability and viable cells/mL were noted. Cells were diluted to a desired concentration and seeded on collagen I-coated plates. Cells were pipetted slowly and gently onto plate, only 1-2 wells at a time. The remaining cells were mixed in the tubes frequently by gentle inversion. Cells were seeded at about $8.5 \times 10^6$ cells per plate in 6 mL cold plating medium (10 cm). Alternatively, $1.5 \times 10^6$ cells per well for a 6-well plate (1 mL medium/well); $7 \times 10^5$ cells per well for 12-well plate (0.5 mL/well); or $3.75 \times 10^5$ cells per well for a 24-well plate (0.5 mL/well)

After all cells and medium were added to the plate, the plate was transferred to an incubator (37° C., 5% $CO_2$, about 90% humidity) and rocked forwards and backwards, then side to side several times each to distribute cells evenly across the plate or wells. The plate(s) were rocked again every 15 minutes for the first hour post-plating. About 4 hours post-plating (or first thing the morning if cells were plated in the evening), cells were washed once with PBS and complete maintenance medium was added. The primary human hepatocytes were maintained in the maintenance medium and transferred to fresh medium daily.

B. Starvation and Compound Treatment of Hepatocytes

Two to three hours before treatment, cells cultured as described above were washed with PBS and the medium was changed to either: fresh maintenance medium (complete) or modified maintenance medium 4b.

Compound stocks were prepared at 1000× final concentration and added in a 2-step dilution to the medium to reduce risk of a compound precipitating out of solution when added to the cells, and to ensure reasonable pipetting volumes. One at a time, each compound was first diluted 10-fold in warm (about 37° C.) modified maintenance medium (initial dilution=ID), mixed by vortexing, and the ID was diluted 100-fold into the cell culture (e.g. 5.1 μl into 1 well of a 24-well plate containing 0.5 mL medium). The plate was mixed by carefully swirling and after all wells were treated and returned to the incubator overnight. If desired, separate plates/wells were treated with vehicle-only controls and/or positive controls. If using multi-well plates, controls were included on each plate. After about 18 hours, cells were harvested for further analysis, e.g., ChIP-seq, RNA-seq, ATAC-seq, etc.

C. Media Composition

The thaw medium contained 6 mL isotonic percoll and 14 mL high glucose DMEM (Invitrogen #11965 or similar). The plating medium contained 100 mL Williams E medium (Invitrogen #A1217601, without phenol red) and the supplement pack #CM3000 from ThermoFisher Plating medium containing 5 mL FBS, 10 μl dexamethasone, and 3.6 mL plating/maintenance cocktail. Stock trypan blue (0.4%, Invitrogen #15250) was diluted 1:5 in PBS.

The ThermoFisher complete maintenance medium contained supplement pack #CM4000 (1 μl dexamethasone and 4 mL maintenance cocktail) and 100 mL Williams E (Invitrogen #A1217601, without phenol red).

The modified maintenance media had no stimulating factors (dexamethasone, insulin, etc.), and contained 100 mL Williams E (Invitrogen #A1217601, without phenol red), 1 mL L-Glutamine (Sigma #G7513) to 2 mM, 1.5 mL HEPES (VWR 0848) to 15 mM, and 0.5 mL penicillin/streptomycin (Invitrogen #15140) to a final concentration of 50 U/mL each.

D. DNA Purification

DNA purification was conducted as described in Ji et al., *PNAS* 112(12):3841-3846 (2015) Supporting Information, which is hereby incorporated by reference in its entirety. One milliliter of 2.5 M glycine was added to each plate of fixed cells and incubated for 5 minutes to quench the formaldehyde. The cells were washed twice with PBS. The cells were pelleted at 1,300 g for 5 minutes at 4° C. Then, $4 \times 10^7$ cells were collected in each tube. The cells were lysed gently with 1 mL of ice-cold Nonidet P-40 lysis buffer containing protease inhibitor on ice for 5 minutes (buffer recipes are provided below). The cell lysate was layered on top of 2.5 volumes of sucrose cushion made up of 24% (wt/vol) sucrose in Nonidet P-40 lysis buffer. This sample was centrifuged at 18,000 g for 10 minutes at 4° C. to isolate the nuclei pellet (the supernatant represented the cytoplasmic fraction). The nuclei pellet was washed once with PBS/1 mM EDTA. The nuclei pellet was resuspended gently with 0.5 mL glycerol buffer followed by incubation for 2 minutes on ice with an equal volume of nuclei lysis buffer. The sample was centrifuged at 16,000 g for 2 minutes at 4° C. to isolate the chromatin pellet (the supernatant represented the nuclear soluble fraction). The chromatin pellet was washed twice with PBS/1 mM EDTA. The chromatin pellet was stored at −80° C.

The Nonidet P-40 lysis buffer contained 10 mM Tris-HCl (pH 7.5), 150 mM NaCl, and 0.05% Nonidet P-40. The glycerol buffer contained 20 mM Tris-HCl (pH 7.9), 75 mM NaCl, 0.5 mM EDTA, 0.85 mM DTT, and 50% (vol/vol) glycerol. The nuclei lysis buffer contained 10 mM Hepes (pH 7.6), 1 mM DTT, 7.5 mM $MgCl_2$, 0.2 mM EDTA, 0.3 M NaCl, 1 M urea, and 1% Nonidet P-40.

E. Chromatin Immunoprecipitation Sequencing (ChIP-Seq)

ChIP-seq was performed using the following protocol for primary hepatocytes and HepG2 cells to determine the composition and confirm the location of signaling centers.

i. Cell Cross-Linking $2 \times 10^7$ cells were used for each run of ChIP-seq. Two ml of fresh 11% formaldehyde (FA) solution was added to 20 ml media on 15 cm plates to reach a 1.1% final concentration. Plates were swirled briefly and incubated at room temperature (RT) for 15 minutes. At the end of incubation, the FA was quenched by adding 1 ml of 2.5M Glycine to plates and incubating for 5 minutes at RT. The media was discarded to a 1 L beaker, and cells were washed twice with 20 ml ice-cold PBS. PBS (10 ml) was added to plates, and cells were scraped off the plate. The cells were transferred to 15 ml conical tubes, and the tubes were placed on ice. Plates were washed with an additional 4 ml of PBS and combined with cells in 15 ml tubes. Tubes were centrifuged for 5 minutes at 1,500 rpm at 4° C. in a tabletop centrifuge. PBS was aspirated, and the cells were flash frozen in liquid nitrogen. Pellets were stored at −80° C. until ready to use.

ii. Pre-Block Magnetic Beads

Thirty μl Protein G beads (per reaction) were added to a 1.5 ml Protein LoBind Eppendorf tube. The beads were collected by magnet separation at RT for 30 seconds. Beads were washed 3 times with 1 ml of blocking solution by incubating beads on a rotator at 4° C. for 10 minutes and collecting the beads with the magnet. Five μg of an antibody was added to the 250 μl of beads in block solution. The mix was transferred to a clean tube, and rotated overnight at 4° C. On the next day, buffer containing antibodies was removed, and beads were washed 3 times with 1.1 ml blocking solution by incubating beads on a rotator at 4° C. for 10 minutes and collecting the beads with the magnet. Beads were resuspended in 50 μl of block solution and kept on ice until ready to use.

iii. Cell Lysis, Genomic Fragmentation, and Chromatin Immunoprecipitation

COMPLETE® protease inhibitor cocktail was added to lysis buffer 1 (LB1) before use. One tablet was dissolved in 1 ml of $H_2O$ for a 50× solution. The cocktail was stored in aliquots at −20° C. Cells were resuspended in each tube in 8 ml of LB1 and incubated on a rotator at 4° C. for 10 minutes. Nuclei were spun down at 1,350 g for 5 minutes at 4° C. LB1 was aspirated, and cells were resuspended in each tube in 8 ml of LB2 and incubated on a rotator at 4° C. for 10 minutes.

A COVARIS® E220EVOLUTION™ ultrasonicator was programmed per the manufacturer's recommendations for high cell numbers. HepG2 cells were sonicated for 12 minutes, and primary hepatocyte samples were sonicated for 10 minutes. Lysates were transferred to clean 1.5 ml Eppendorf tubes, and the tubes were centrifuged at 20,000 g for 10 minutes at 4° C. to pellet debris. The supernatant was transferred to a 2 ml Protein LoBind Eppendorf tube containing pre-blocked Protein G beads with pre-bound antibodies. Fifty µl of the supernatant was saved as input. Input material was kept at −80° C. until ready to use. Tubes were rotated with beads overnight at 4° C.

iv. Wash, Elution, and Cross-Link Reversal

All washing steps were performed by rotating tubes for 5 minutes at 4° C. The beads were transferred to clean Protein LoBind Eppendorf tubes with every washing step. Beads were collected in 1.5 ml Eppendorf tube using a magnet. Beads were washed twice with 1.1 ml of sonication buffer. The magnetic stand was used to collect magnetic beads. Beads were washed twice with 1.1 ml of wash buffer 2, and the magnetic stand was used again to collect magnetic beads. Beads were washed twice with 1.1 ml of wash buffer 3. All residual Wash buffer 3 was removed, and beads were washed once with 1.1 ml TE+0.2% Triton X-100 buffer. Residual TE+0.2% Triton X-100 buffer was removed, and beads were washed twice with TE buffer for 30 seconds each time. Residual TE buffer was removed, and beads were resuspended in 300 µl of ChIP elution buffer. Two hundred fifty µl of ChIP elution buffer was added to 50 µl of input, and the tubes were rotated with beads 1 hour at 65° C. Input sample was incubated overnight at 65° C. oven without rotation. Tubes with beads were placed on a magnet, and the eluate was transferred to a fresh DNA LoBind Eppendorf tube. The eluate was incubated overnight at 65° C. oven without rotation v. Chromatin Extraction and Precipitation Input and immunoprecipitant (IP) samples were transferred to fresh tubes, and 300 µl of TE buffer was added to IP and Input samples to dilute SDS. RNase A (20 mg/ml) was added to the tubes, and the tubes were incubated at 37° C. for 30 minutes. Following incubation, 3 µl of 1M CaCl$_2$ and 7 µl of 20 mg/ml Proteinase K were added, and incubated 1.5 hours at 55° C. MaXtract High Density 2 ml gel tubes (Qiagen) were prepared by centrifugation at full speed for 30 seconds at RT. Six hundred µl of phenol/chloroform/isoamyl alcohol was added to each proteinase K reaction and transferred in about 1.2 ml mixtures to the MaXtract tubes. Tubes were spun at 16,000 g for 5 minutes at RT. The aqueous phase was transferred to two clean DNA LoBind tubes (300 µl in each tube), and 1.5 µl glycogen, 30 µl of 3M sodium acetate, and 900 µl ethanol were added. The mixture was precipitated overnight at −20° C. or for 1 hour at −80° C., and spun down at maximum speed for 20 minutes at 4° C. The ethanol was removed, and pellets were washed with 1 ml of 75% ethanol by spinning tubes down at maximum speed for 5 minutes at 4° C. Remnants of ethanol were removed, and pellets were dried for 5 min at RT. Twenty-five µl of H2O was added to each immunoprecipitant (IP) and input pellet, left standing for 5 minutes, and vortexed briefly. DNA from both tubes was combined to obtain 50 µl of IP and 50 µl of input DNA for each sample. One µl of this DNA was used to measure the amount of pulled down DNA using Qubit dsDNA HS assay (ThermoFisher, #Q32854). The total amount of immunoprecipitated material ranged from several ng (for TFs) to several hundred ng (for chromatin modifications). Six µl of DNA was analyzed using qRT-PCR to determine enrichment. The DNA was diluted if necessary. If enrichment was satisfactory, the rest was used for library preparation for DNA sequencing.

vi. Library Preparation for DNA Sequencing

Libraries were prepared using NEBNext Ultra II DNA library prep kit for Illumina (NEB, #E7645) using NEBNext Multiplex Oligos for Illumina (NEB, #6609S) according to manufacturer's instructions with the following modifications. The remaining ChIP sample (about 43 µl) and 1 µg of input samples for library preparations were brought up the volume of 50 µl before the End Repair portion of the protocol. End Repair reactions were run in a PCR machine with a heated lid in a 96-well semi-skirted PCR plate (ThermoFisher, #AB1400) sealed with adhesive plate seals (ThermoFisher, #AB0558) leaving at least one empty well in-between different samples. Undiluted adapters were used for input samples, 1:10 diluted adapters for 5-100 ng of ChIP material, and 1:25 diluted adapters for less than 5 ng of ChIP material. Ligation reactions were run in a PCR machine with the heated lid off. Adapter ligated DNA was transferred to clean DNA LoBind Eppendorf tubes, and the volume was brought to 96.5 µl using H2O.

200-600 bp ChIP fragments were selected using SPRIselect magnetic beads (Beckman Coulter, #B23317). Thirty µl of the beads were added to 96.5 µl of ChIP sample to bind fragments that are longer than 600 bp. The shorter fragments were transferred to a fresh DNA LoBind Eppendorf tube. Fifteen µl of beads were added to bind the DNA longer than 200 bp, and beads were washed with DNA twice using freshly prepared 75% ethanol. DNA was eluted using 17 µl of 0.1×TE buffer. About 15 µl was collected.

Three µl of size-selected Input sample and all (15 µl) of the ChIP sample was used for PCR. The amount of size-selected DNA was measured using a Qubit dsDNA HS assay. PCR was run for 7 cycles of for Input and ChIP samples with about 5-10 ng of size-selected DNA, and 12 cycles with less than 5 ng of size-selected DNA. One-half of the PCR product (25 µl) was purified with 22.5 µl of AMPure XP beads (Beckman Coulter, #A63880) according to the manufacturer's instructions. PCR product was eluted with 17 µl of 0.1×TE buffer, and the amount of PCT product was measured using Qubit dsDNA HS assay. An additional 4 cycles of PCR were run for the second half of samples with less than 5 ng of PCR product, DNA was purified using 22.5 µl of AMPure XP beads. The concentration was measured to determine whether there was an increased yield. Both halves were combined, and the volume was brought up to 50 µl using H2O.

A second round of purifications of DNA was run using 45 µl of AMPure XP beads in 17 µl of 0.1×TE, and the final yield was measured using Qubit dsDNA HS assay. This protocol produces from 20 ng to 1 mg of PCR product. The quality of the libraries was verified by diluting 1 µl of each sample with H2O if necessary using the High Sensitivity BioAnalyzer DNA kit (Agilent, #5067-4626) based on manufacturer's recommendations.

vii. Reagents

11% Formaldehyde Solution (50 mL) contained 14.9 ml of 37% formaldehyde (final conc. 11%), 1 ml of 5M NaCl (final conc. 0.1 M), 100 µl of 0.5M EDTA (pH 8) (final conc. 1 mM), 50 µl of 0.5M EGTA (pH 8) (final conc. 0.5 mM), and 2.5 ml 1M Hepes (pH 7.5) (final conc. 50 mM).

Block Solution contained 0.5% BSA (w/v) in PBS and 500 mg BSA in 100 ml PBS. Block solution may be prepared up to about 4 days prior to use.

Lysis buffer 1 (LB1) (500 ml) contained 25 ml of 1 M Hepes-KOH, pH 7.5; 14 ml of 5M NaCl; 1 ml of 0.5M EDTA, pH 8.0; 50 ml of 100% Glycerol solution; 25 ml of 10% NP-40; and 12.5 ml of 10% Triton X-100. The pH was adjusted to 7.5. The buffer was sterile-filtered, and stored at 4° C. The pH was re-checked immediately prior to use.

Lysis buffer 2 (LB2) (1000 ml) contained 10 ml of 1 M Tris-HCL, pH 8.0; 40 ml of 5 M NaCl; 2 ml of 0.5M EDTA, pH 8.0; and 2 ml of 0.5M EGTA, pH 8.0. The pH was adjusted to 8.0. The buffer was sterile-filtered, and stored at 4° C. The pH was re-checked immediately prior to use.

Sonication buffer (500 ml) contained 25 ml of 1M Hepes-KOH, pH 7.5; 14 ml of 5M NaCl; 1 ml of 0.5M EDTA, pH 8.0; 50 ml of 10% Triton X-100; 10 ml of 5% Na-deoxycholate; and 5 ml of 10% SDS. The pH was adjusted to 7.5. The buffer was sterile-filtered, and stored at 4° C. The pH was re-checked immediately prior to use.

Proteinase inhibitors were included in the LB1, LB2, and Sonication buffer.

Wash Buffer 2 (500 ml) contained 25 ml of 1M Hepes-KOH, pH 7.5; 35 ml of 5M NaCl; 1 ml of 0.5M EDTA, pH 8.0; 50 ml of 10% Triton X-100; 10 ml of 5% Na-deoxycholate; and 5 ml of 10% SDS. The pH was adjusted to 7.5. The buffer was sterile-filtered, and stored at 4° C. The pH was re-checked immediately prior to use.

Wash Buffer 3 (500 ml) contained 10 ml of 1M Tris-HCL, pH 8.0; 1 ml of 0.5M EDTA, pH 8.0; 125 ml of 1M LiCl solution; 25 ml of 10% NP-40; and 50 ml of 5% Na-deoxycholate. The pH was adjusted to 8.0. The buffer was sterile-filtered, and stored at 4° C. The pH was re-checked immediately prior to use.

ChIP elution Buffer (500 ml) contained 25 ml of 1 M Tris-HCL, pH 8.0; 10 ml of 0.5M EDTA, pH 8.0; 50 ml of 10% SDS; and 415 ml of ddH$_2$O. The pH was adjusted to 7.5. The buffer was sterile-filtered, and stored at 4° C. The pH was re-checked immediately prior to use.

F. Analysis of ChIP-Seq Results

All pass filter reads from each sample were trimmed of sequencing adapters using trim galore 0.4.4 with default options. Trimmed reads were mapped against the human genome (assembly GRCh38/GCA_000001405.15 "no alt" analysis set merged with hs38d1/GCA_000786075.2) using bwa version 0.7.15 (Li (2013) arXiv:1303.3997v1) with default parameters. Aligned read duplicates were assessed using picard 2.9.0 (http://broadinstitute.hithub.io/picard) and reads with a MAPQ<20 or those matching standard SAM flags 0×1804 were discarded. Standard QC were applied (read integrity, mapping statistics, library complexity, fragment bias) to remove unsatisfactory samples. Enriched ChIP-seq peaks were identified by comparing samples against whole cell extract controls using MACS2 version 2.1.0 (Zhang et al., Genome Biol. (2008) 9(9): R137), with significant peaks selected as those with an adjusted p-value <0.01. Peaks overlapping known repetitive "blacklist" regions (ENCODE Project Consortium, Nature (2012) 489(7414:57-74) were discarded. ChIP-seq signals were also normalized by read depth and visualized using the UCSC browser.

G. RNA-Seq

This protocol is a modified version of the following protocols: MagMAX mir Vana Total RNA Isolation Kit User Guide (Applied Biosystems #MAN0011131 Rev B.0), NEBNext Poly(A) mRNA Magnetic Isolation Module (E7490), and NEBNext Ultra Directional RNA Library Prep Kit for Illumina (E7420) (New England Biosystems #E74901).

The MagMAX mir Vana kit instructions (the section titled "Isolate RNA from cells" on pages 14-17) were used for isolation of total RNA from cells in culture. Two hundred µl of Lysis Binding Mix was used per well of the multiwell plate containing adherent cells (usually a 24-well plate).

For mRNA isolation and library prep, the NEBNext Poly(A) mRNA Magnetic Isolation Module and Directional Prep kit was used. RNA isolated from cells above was quantified, and prepared in 500 µg of each sample in 50 µl of nuclease-free water. This protocol may be run in microfuge tubes or in a 96-well plate.

The 80% ethanol was prepared fresh, and all elutions are done in 0.1×TE Buffer. For steps requiring Ampure XP beads, beads were at room temperature before use. Sample volumes were measured first and beads were pipetted. Section 1.9B (not 1.9A) was used for NEBNext Multiplex Oligos for Illumina (#E6609). Before starting the PCR enrichment, cDNA was quantified using the Qubit (DNA High Sensitivity Kit, ThermoFisher #Q32854). The PCR reaction was run for 12 cycles.

After purification of the PCR Reaction (Step 1.10), the libraries were quantified using the Qubit DNA High Sensitivity Kit. 1 µl of each sample were diluted to 1-2 ng/µl to run on the Bioanalyzer (DNA High Sensitivity Kit, Agilent #5067-4626). If Bioanalyzer peaks were not clean (one narrow peak around 300 bp), the AMPure XP bead cleanup step was repeated using a 0.9× or 1.0× beads:sample ratio. Then, the samples were quantified again with the Qubit, and run again on the Bioanalyzer (1-2 ng/µl).

Nuclear RNA from INTACT-purified nuclei or whole neocortical nuclei was converted to cDNA and amplified with the Nugen Ovation RNA-seq System V2. Libraries were sequenced using the Illumina HiSeq 2500.

H. RNA-Seq Data Analysis

All pass filter reads from each sample were mapped against the human genome (assembly GRCh38/GCA_000001405.15 "no alt" analysis set merged with hs38d1/GCA_000786075.2) using two pass mapping via STAR version 2.5.3a (alignment parameters alignIntronMin=20; alignIntronMax=1000000; outFilterMismatchNmax=999; outFilterMismatchNoverLmax=0.05; outFilterType=BySJout; outFilterMultimapNmax=20; alignSJoverhangMin=8; alignSJDBoverhangMin=1; alignMatesGapMax=1000000) (Dobin et al., Bioinformatics (2012) 29(1): 15-21). Genomic alignments were converted to transcriptome alignments based on reference transcript annotations from The Human GENCODE Gene Set release 24 (Harrow et al., Genome Res. (2012) 22(9): 1760-1774). Using unique and multimapped transcriptomic alignments, gene-level abundance estimates were computed using RSEM version 1.3.0 (Li and Dewey, BMC Bioinformatics (2011) 12:323) in a strand-aware manner, and including confidence interval sampling calculations, to arrive at posterior mean estimates (PME) of abundances (counts and normalized FPKM—fragments per kilobase of exon per million mapped fragments) from the underlying Bayesian model. Standard QC were applied (read integrity, mapping statistics, library complexity, fragment bias) to remove unsatisfactory samples. Differential gene expression was computed using the negative binomial model implemented by DESeq2 version 1.16.1 (Love et al., Genome Biol. (2014) 15(12):550). Log 2 fold change and significance values were computed using PME count data (with replicates explicitly modeled versus pan-experiment controls), median ratio normalized, using maximum likelihood estimation rather than maximum a posteriori, and disabling the use of Cook's distance cutoff when determining acceptable adjusted p-values. Significantly differential genes were assigned as those with an adjusted p-value <0.01, a log 2 fold change of >=1 or <=−1, and at least one replicate with PME FPKM>=1. RNA-seq signals were also normalized by read depth and visualized using the UCSC browser.

I. ATAC-seq

Hepatocytes were seeded overnight, then the serum and other factors were removed. After 2-3 hours, the cells were treated with the compound and incubated overnight. The cells were harvested and the nuclei were prepared for the transposition reaction. 50,000 bead bound nuclei were transposed using Tn5 transposase (Illumina FC-121-1030) as described in Mo et al., 2015, Neuron 86, 1369-1384, which is hereby incorporated by reference in its entirety. After 9-12 cycles of PCR amplification, libraries were sequenced on an Illumina HiSeq 2000. PCR was performed using barcoded primers with extension at 72° C. for 5 minutes, PCR, then the final PCR product was sequenced.

All obtained reads from each sample were trimmed using trim galore 0.4.1 requiring Phred score ≥20 and read length ≥30 for data analysis. The trimmed reads were mapped against the human genome (hg19 build) using Bowtie2 (version 2.2.9) with the parameters: -t -q -N 1 -L 25 -X 2000 no-mixed no-discordant. All unmapped reads, non-uniquely mapped reads and PCR duplicates were removed. All the ATAC-seq peaks were called using MACS2 with the parameters --nolambda -nomodel -q 0.01 --SPMR. The ATAC-seq signal was visualized in the UCSC genome browser. ATAC-seq peaks that were at least 2 kb away from annotated promoters (RefSeq, Ensemble and UCSC Known Gene databases combined) were selected as distal ATAC-seq peaks.

J. qRT-PCR qRT-PCR was performed as described in North et al., PNAS, 107(40) 17315-17320 (2010), which is hereby incorporated by reference in its entirety. qRT-PCR was performed with cDNA using the iQ5 Multicolor rtPCR Detection system from BioRad with 60° C. annealing.

Analysis of the fold changes in expression as measured by qRT-PCR were performed using the technique below. The control was DMSO, and the treatment was the selected compound (CPD). The internal control was GAPDH or B-Actin, and the gene of interest is the target. First, the averages of the 4 conditions were calculated for normalization: DMSO:GAPDH, DMSO:Target, CPD:GAPDH, and CPD:Target. Next, the $\Delta$CT of both control and treatment were calculated to normalize to internal control (GAPDH) using (DMSO:Target)−(DMSO:GAPDH)=$\Delta$CT control and (CPD:Target)−(CPD:GAPDH)=$\Delta$CT experimental. Then, the $\Delta\Delta$CT was calculated by $\Delta$CT experimental−$\Delta$CT control. The Expression Fold Change was calculated by 2−($\Delta\Delta$CT) (2-fold expression change was shown by RNA-Seq results provided herein).

K. Chromatin Interaction Analysis by Paired-End Tag Sequencing (ChIA-PET)

ChIA-PET was performed as previously described in Chepelev et al. (2012) Cell Res. 22, 490-503; Fullwood et al. (2009) Nature 462, 58-64; Goh et al. (2012) J. Vis. Exp., http://dx.doi.org/10.3791/3770; Li et al. (2012) Cell 148, 84-98; and Dowen et al. (2014) Cell 159, 374-387, which are each hereby incorporated by reference in their entireties. Briefly, embryonic stem (ES) cells (up to $1\times10^8$ cells) were treated with 1% formaldehyde at room temperature for 20 minutes and then neutralized using 0.2M glycine. The cross-linked chromatin was fragmented by sonication to size lengths of 300-700 bp. The anti-SMC1 antibody (Bethyl, A300-055A) was used to enrich SMC1-bound chromatin fragments. A portion of ChIP DNA was eluted from antibody-coated beads for concentration quantification and for enrichment analysis using quantitative PCR. For ChIA-PET library construction ChIP DNA fragments were end-repaired using T4 DNA polymerase (NEB). ChIP DNA fragments were divided into two aliquots and either linker A or linker B was ligated to the fragment ends. The two linkers differ by two nucleotides which were used as a nucleotide barcode (Linker A with CG; Linker B with AT). After linker ligation, the two samples were combined and prepared for proximity ligation by diluting in a 20 ml volume to minimize ligations between different DNA-protein complexes. The proximity ligation reaction was performed with T4 DNA ligase (Fermentas) and incubated without rocking at 22° C. for 20 hours. During the proximity ligation DNA fragments with the same linker sequence were ligated within the same chromatin complex, which generated the ligation products with homodimeric linker composition. However, chimeric ligations between DNA fragments from different chromatin complexes could also occur, thus producing ligation products with heterodimeric linker composition. These heterodimeric linker products were used to assess the frequency of nonspecific ligations and were then removed.

i. Day 1

The cells were crosslinked as described for ChIP. Frozen cell pellets were stored in the −80° C. freezer until ready to use. This protocol requires at least $3\times10^8$ cells frozen in six 15 ml Falcon tubes (50 million cells per tube). Six 100 µl Protein G Dynabeads (for each ChIA-PET sample) was added to six 1.5 ml Eppendorf tubes on ice. Beads were washed three times with 1.5 ml Block solution, and incubated end over end at 4° C. for 10 minutes between each washing step to allow for efficient blocking. Protein G Dynabeads were resuspended in 250 µl of Block solution in each of six tubes and 10 µg of SMC1 antibody (Bethyl A300-055A) was added to each tube. The bead-antibody mixes were incubated at 4° C. end-over-end overnight.

ii. Day 2

Beads were washed three times with 1.5 ml Block solution to remove unbound IgG and incubated end-over-end at 4° C. for 10 minutes each time. Smc I-bound beads were resuspended in 100 µl of Block solution and stored at 4° C. Final lysis buffer 1 (8 ml per sample) was prepared by adding 50× Protease inhibitor cocktail solution to Lysis buffer 1 (LB1) (1:50). Eight ml of Final lysis buffer 1 was added to each frozen cell pellet (8 ml per sample×6). The cells were thoroughly resuspended and thawed on ice by pipetting up and down. The cell suspension was incubated again end-over-end for 10 minutes at 4° C. The suspension was centrifuged at 1,350×g for 5 minutes at 4° C. Concurrently, Final lysis buffer 2 (8 ml per sample) was prepared by adding 50× Protease inhibitor cocktail solution to lysis buffer 2 (LB2) (1:50)

After centrifugation, the supernatant was discarded, and the nuclei were thoroughly resuspended in 8 ml Final lysis buffer 2 by pipetting up and down. The cell suspension was incubated end-over-end for 10 minutes at 4° C. The suspension was centrifuged at 1,350×g for 5 minutes at 4° C. During incubation and centrifugation, the Final sonication buffer (15 ml per sample) was prepared by adding 50× Protease inhibitor cocktail solution to sonication buffer (1:50). The supernatant was discarded, and the nuclei were fully resuspended in 15 ml Final sonication buffer by pipetting up and down. The nuclear extract was extracted to fifteen 1 ml Covaris Evolution E220 sonication tubes on ice. An aliquot of 10 µl was used to check the size of unsonicated chromatin on a gel.

A Covaris sonicator was programmed according to manufacturer's instructions (12 minutes per 20 million cells=12× 15=3 hours). The samples were sequentially sequenced as described above. The goal is to break chromatin DNA to 200-600 bp. If sonication fragments are too big, false positives become more frequent. The sonicated nuclear extract was dispensed into 1.5 ml Eppendorf tubes. 1.5 ml samples are centrifuged at full speed at 4° C. for 10 minutes. Supernatant (SNE) was pooled into a new pre-cooled 50 ml Falcon tube, and brought to a volume of 18 ml with sonication buffer. Two tubes of 50 µl were taken as input and to check the size of fragments. 250 µl of ChIP elution buffer was added and reverse crosslinking occurred at 65° C. overnight in the oven After reversal of crosslinking, the size of sonication fragments was determined on a gel.

Three ml of sonicated extract was added to 100 µl Protein G beads with SMC1 antibodies in each of six clean 15 ml Falcon tubes. The tubes containing SNE-bead mix were incubated end-over-end at 4° C. overnight (14 to 18 hours).

iii. Day 3

Half the volume (1.5 ml) of the SNE-bead mix was added to each of six pre-chilled tubes and SNE was removed using a magnet. The tubes were sequentially washed as follows: 1) 1.5 ml of Sonication buffer was added, the beads were resuspended and rotated for 5 minutes at 4° C. for binding, then the liquid was removed (step performed twice); 2) 1.5 ml of high-salt sonication buffer was added, and the beads were resuspended and rotated for 5 minutes at 4° C. for binding, then the liquid was removed (step performed twice); 3) 1.5 ml of high-salt sonication buffer was added, and the beads were resuspended and rotated for 5 minutes at 4° C. for binding, then the liquid was removed (step performed twice); 4) 1.5 ml of LiCl buffer was added, and the cells were resuspended and incubated end-over-end for 5 minutes for binding, then the liquid was removed (step performed twice); 5) 1.5 ml of 1×TE+0.2% Triton X-100 was used to wash the cells for 5 minutes for binding, then the liquid was removed; and 1.5 ml of ice-cold TE Buffer was used to wash the cells for 30 seconds for binding, then the liquid was removed (step performed twice). Beads from all six tubes were sequentially resuspended in beads in one 1,000 ul tube of 1× ice-cold TE buffer.

ChIP-DNA was quantified using the following protocol. Ten percent of beads (by volume), or 100 µl, were transferred into a new 1.5 ml tube, using a magnet. Beads were resuspended in 300 µl of ChIP elution buffer and the tube was rotated with beads for 1 hour at 65° C. The tube with beads was placed on a magnet and the eluate was transferred to a fresh DNA LoBind Eppendorf tube. The eluate was incubated overnight at 65° C. oven without rotating. Immuno-precipitated samples were transferred to fresh tubes, and 300 µl of TE buffer was added to the immuno-precipitants and Input samples to dilute. Five µl of RNase A (20 mg/ml) was added, and the tube was incubated at 37° C. for 30 minutes.

Following incubation, 3 µl of 1M CaCl$_2$ and 7 µl of 20 mg/ml Proteinase K was added to the tube and incubated 1.5 hours at 55° C. MaXtract High Density 2 ml gel tubes (Qiagen) were prepared by centrifuging them at full speed for 30 seconds at RT. 600 µl of phenol/chloroform/isoamyl alcohol was added to each proteinase K reaction. About 1.2 ml of the mixtures was transferred to the MaXtract tubes. Tubes were spun at 16,000 g for 5 minutes at RT. The aqueous phase was transferred to two clean DNA LoBind tubes (300 µl in each tube), and 1 µl glycogen, 30 µl of 3M sodium acetate, and 900 µl ethanol was added. The mixture was allowed to precipitate overnight at −20° C. or for 1 hour at −80° C.

The mixture was spun down at maximum speed for 20 minutes at 4° C., ethanol was removed, and the pellets were washed with 1 ml of 75% ethanol by spinning tubes down at maximum speed for 5 minutes at 4° C. All remnants of ethanol were removed, and pellets were dried for 5 minutes at RT. H2O was added to each tube. Each tube was allowed to stand for 5 minutes, and vortexed briefly. DNA from both tubes was combined to obtain 50 µl of IP and 100 µl of Input DNA.

The amount of DNA collected was quantitated by ChIP using Qubit (Invitrogen #Q32856). One µl intercalating dye was combined with each measure 1 µl of sample. Two standards that come with the kit were used. DNA from only 10% of the beads was measured. About 400 ng of chromatin in 900 µl of bead suspension was obtained with a good enrichment at enhancers and promoters as measured by qPCR.

iv. Day 3 or 4

End-blunting of ChIP-DNA was performed on the beads using the following protocol.

The remaining chromatin/beads were split by pipetting, and 450 µl of bead suspension was aliquoted into 2 tubes. Beads were collected on a magnet. Supernatant was removed, and then the beads were resuspended in the following reaction mix: 70 µl 10×NEB buffer 2.1 (NEB, M0203L), 7 µl 10 mM dNTPs, 615.8 µl dH$_2$O, and 7.41 of 3 U/µl T4 DNA Polymerase (NEB, M0203L). The beads were incubated at 37° C. with rotation for 40 minutes. Beads were collected with a magnet, then the beads were washed 3 times with 1 ml ice-cold ChIA-PET Wash Buffer (30 seconds per each wash).

On-Bead A-tailing was performed by preparing Klenow (3' to 5' exo-) master mix as stated below: 70 µl 10×NEB buffer 2, 7 µl 10 mM dATP, 616 µl dH$_2$O, and 7 µl of 3 U/µl Klenow (3' to 5' exo-) (NEB, M0212L). The mixture was incubated at 37° C. with rotation for 50 minutes. Beads were collected with a magnet, then beads were washed 3 times with 1 ml of ice-cold ChIA-PET Wash Buffer (30 seconds per each wash).

Linkers were thawed gently on ice. Linkers were mixed well with water gently by pipetting, then with PEG buffer, then gently vortexed. Then, 1394 µl of master mix and 6 µl of ligase was added per tube and mixed by inversion. Parafilm was put on the tube, and the tube was incubated at 16° C. with rotation overnight (at least 16 hours). The biotinylated linker was ligated to ChIP-DNA on beads by setting up the following reaction mix and adding reagents in order: 1110 µl dH$_2$O, 4 µl 200 ng/µl biotinylated bridge linker, 280 µl 5× T4 DNA ligase buffer with PEG (Invitrogen), and 6 µl 30 U/µl T4 DNA ligase (Fermentas).

v. Day 5

Exonuclease lambda/Exonuclease I On-Bead digestion was performed using the following protocol. Beads were collected with a magnet and washed 3 times with 1 ml of ice-cold ChIA-PET Wash Buffer (30 seconds per each wash). The Wash buffer was removed from beads, then resuspended in the following reaction mix: 70 µl 10× lambda nuclease buffer (NEB, M0262L), 618 µl nuclease-free dH$_2$O, 6 µl 5 U/µl Lambda Exonuclease (NEB, M0262L), and 6 µl Exonuclease I (NEB, M0293L). The reaction was incubated at 37° C. with rotation for 1 hour. Beads were collected with a magnet, and beads were washed 3 times with 1 ml ice-cold ChIA-PET Wash Buffer (30 seconds per each wash).

Chromatin complexes were eluted off the beads by removing all residual buffer and resuspending the beads in 300 µl of ChIP elution buffer. The tube with beads was rotated 1 hour at 65° C. The tube was placed on a magnet and the eluate was transferred to a fresh DNA LoBind Eppendorf tube. The eluate was incubated overnight at 65° C. in an oven without rotating.

vi. Day 6

The eluted sample was transferred to a fresh tube and 300 µl of TE buffer was added to dilute the SDS. Three µl of RNase A (30 mg/ml) was added to the tube, and the mixture was incubated at 37° C. for 30 minutes. Following incubation, 3 µl of 1M $CaCl_2$ and 7 µl of 20 mg/ml Proteinase K was added, and the tube was incubated again for 1.5 hours at 55° C. MaXtract High Density 2 ml gel tubes (Qiagen) were precipitated by centrifuging them at full speed for 30 seconds at RT. Six hundred µl of phenol/chloroform/isoamyl alcohol was added to each proteinase K reaction, and about 1.2 ml of the mixture was transferred to the MaXtract tubes. Tubes were spun at 16,000×g for 5 minutes at RT.

The aqueous phase was transferred to two clean DNA LoBind tubes (300 µl in each tube), and 1 µl glycogen, 30 µl of 3M sodium acetate, and 900 µl ethanol is added. The mixture was precipitated for 1 hour at −80° C. The tubes were spun down at maximum speed for 30 minutes at 4° C., and the ethanol was removed. The pellets were washed with 1 ml of 75% ethanol by spinning tubes down at maximum speed for 5 minutes at 4° C. Remnants of ethanol were removed, and the pellets were dried for 5 minutes at RT. Thirty µl of H2O was added to the pellet and allowed to stand for 5 minutes. The pellet mixture was vortexed briefly, and spun down to collect the DNA.

Qubit and DNA High Sensitivity ChIP were performed to quantify and assess the quality of proximity ligated DNA products. About 120 ng of the product was obtained.

vii. Day 7

Components for Nextera tagmentation were then prepared. One hundred ng of DNA was divided into four 25 µl reactions containing 12.5 µl 2× Tagmentation buffer (Nextera), 1 µl nuclease-free $dH_2O$, 2.5 µl Tn5 enzyme (Nextera), and 9 µl DNA (25 ng). Fragments of each of the reactions were analyzed on a Bioanalyzer for quality control.

The reactions were incubated at 55° C. for 5 minutes, then at 10° C. for 10 minutes. Twenty-five µl of H2O was added, and tagmented DNA was purified using Zymo columns. Three hundred fifty µl of Binding Buffer was added to the sample, and the mixture was loaded into a column and spun at 13,000 rpm for 30 seconds. The flow through was re-applied and the columns were spun again. The columns are washed twice with 200 µl of wash buffer and spun for 1 minute to dry the membrane. The column was transferred to a clean Eppendorf tube and 25 µl of Elution buffer was added. The tube was spun down for 1 minute. This step was repeated with another 25 µl of elution buffer. All tagmented DNA was combined into one tube.

ChIA-PETs was immobilized on Streptavidin beads using the following steps. 2× B&W Buffer (40 ml) was prepared as follows for coupling of nucleic acids: 400 µl 1M Tris-HCl pH 8.0 (10 mM final), 80 µl 1M EDTA (1 mM final), 16 ml 5M NaCl (2M final), and 23.52 ml $dH_2O$. 1× B&W Buffer (40 ml total) was prepared by adding 20 ml $dH_2O$ to 20 ml of the 2× B&W Buffer.

MyOne Streptavidin Dynabeads M-280 were allowed to come to room temperature for 30 minutes, and 30 µl of beads were transferred to a new 1.5 ml tube. Beads were washed with 150 µl of 2× B&W Buffer twice. Beads were resuspended in 100 µl of iBlock buffer (Applied Biosystems), and mixed. The mixture was incubated at RT for 45 minutes on a rotator.

I-BLOCK Reagent was prepared to contain: 0.2% I-Block reagent (0.2 g), 1×PBS or 1×TBS (10 ml 10×PBS or 10×TBS), 0.05% Tween-20 (50 µl), and $H_2O$ to 100 ml. 10×PBS and I-BLOCK reagent was added to H2O, and the mixture was microwaved for 40 seconds (not allowed to boil), then stirred. Tween-20 was added after the solution is cooled. The solution remained opaque, but particles dissolved. The solution was cooled to RT for use.

During incubation of beads, 500 ng of sheared genomic DNA was added to 50 µl of $H_2O$ and 50 µl of 2× B&W Buffer. When the beads finished incubating with the iBLOCK buffer, they were washed twice with 200 µl of 1× B&W buffer. The wash buffer was discarded, and 100 µl of the sheared genomic DNA was added. The mixture was incubated with rotation for 30 minutes at RT. The beads were washed twice with 200 µl of 1× B&W buffer. Tagmented DNA was added to the beads with an equal volume of 2× B&W buffer and incubated for 45 minutes at RT with rotation. The beads were washed 5 times with 500 µl of 2×SSC/0.5% SDS buffer (30 seconds each time) followed by 2 washes with 500 ml of 1× B&W Buffer and incubated each after wash for 5 minutes at RT with rotation. The beads were washed once with 100 µl elution buffer (EB) from a Qiagen Kit by resuspending beads gently and putting the tube on a magnet. The supernatant was removed from the beads, and they were resuspended in 30 µl of EB.

A paired end sequencing library was constructed on beads using the following protocol. Ten µl of beads are tested by PCR with 10 cycles of amplification. The 50 µl of the PCR mixture contains: 10 µl of bead DNA, 15 µl NPM mix (from Illumina Nextera kit), 5 µl of PPC PCR primer, 5 µl of Index Primer 1 (i7), 5 µl of Index Primer 2 (i5), and 10 µl of H2O. PCR was performed using the following cycle conditions: denaturing the DNA at 72° C. for 3 minutes, then 10-12 cycles of 98° C. for 10 seconds, 63° C. for 30 seconds, and 72° C. for 50 seconds, and a final extension of 72° C. for 5 minutes. The number of cycles was adjusted to obtain about 300 ng of DNA total with four 25 µl reactions. The PCR product may be held at 4° C. for an indefinite amount of time.

The PCR product was cleaned-up using AMPure beads. Beads were allowed to come to RT for 30 minutes before using. Fifty µl of the PCR reaction was transferred to a new Low-Bind Tube and (1.8× volume) 90 µl of AMPure beads was added. The mixture was pipetted well and incubated at RT for 5 minutes. A magnet was used for 3 minutes to collect beads and remove the supernatant. Three hundred µl of freshly prepared 80% ethanol was added to the beads on the magnet, and the ethanol was carefully discarded. The wash was repeated, and then all ethanol was removed. The beads were dried on the magnet rack for 10 minutes. Ten µl EB was added to the beads, mixed well, and incubated for 5 minutes at RT. The eluate was collected, and 1 µl of eluate was used for Qubit and Bioanalyzer.

The library was cloned to verify complexity using the following protocol. One µl of the library was diluted at 1:10. A PCR reaction was performed as described below. Primers that anneal to Illumina adapters were chosen (Tm=52.2° C.). The PCR reaction mixture (total volume: 50 µl) contained the following: 10 µl of 5× GoTaq buffer, 1 µl of 10 mM dNTP, 5 µl of 10 µM primer mix, 0.25 µl of GoTaq polymerase, 1 µl of diluted template DNA, and 32.75 µl of H2O. PCR was performed using the following cycle conditions: denaturing the DNA at 95° C. for 2 minutes and 20 cycles at the following conditions: 95° C. for 60 seconds, 50° C. for 60 seconds, and 72° C. for 30 seconds with a final extension at 72° C. for 5 minutes. The PCR product may be held at 4° C. for an indefinite amount of time.

The PCR product was ligated with the pGEM® T-Easy vector (Promega) protocol. Five µl of 2× T4 Quick ligase buffer, 1 µl of pGEM® T-Easy vector, 1 µl of T4 ligase, 1 µl of PCR product, and 2 µl of $H_2O$ were combined to a total volume of 10 µl. The product was incubated for 1 hour at RT and 2 µl was used to transform Stellar competent cells. Two hundred µl of 500 µl of cells were plated in SOC media. The next day, 20 colonies were selected for Sanger sequencing using a T7 promoter primer. 60% clones had a full adapter, and 15% had a partial adapter.

viii. Reagents

Protein G Dynabeads for 10 samples were from Invitrogen Dynal, Cat #10003D. Block solution (50 ml) contained 0.25 g BSA dissolved in 50 ml of ddH2O (0.5% BSA, w/v), and was stored at 4° C. for 2 days before use.

Lysis buffer 1 (LB1) (500 ml) contained 25 ml of 1M Hepes-KOH, pH 7.5; 14 ml of 5M NaCl; 1 ml of 0.5 M EDTA, pH 8.0; 50 ml of 100% Glycerol solution; 25 ml of 10% NP-40; and 12.5 ml of 10% Triton X-100. The pH was adjusted to 7.5. The buffer was sterile-filtered, and stored at 4° C. The pH was re-checked immediately prior to use. Lysis buffer 2 (LB2) (1000 ml) contained 10 ml of 1M Tris-HCL, pH 8.0; 40 ml of 5 M NaCl; 2 ml of 0.5 M EDTA, pH 8.0; and 2 ml of 0.5 M EGTA, pH 8.0. The pH was adjusted to 8.0. The buffer was sterile-filtered, and stored at 4° C. The pH was re-checked immediately prior to use.

Sonication buffer (500 ml) contained 25 ml of 1M Hepes-KOH, pH 7.5; 14 ml of 5M NaCl; 1 ml of 0.5 M EDTA, pH 8.0; 50 ml of 10% Triton X-100; 10 ml of 5% Na-deoxycholate; and 5 ml of 10% SDS. The buffer was sterile-filtered, and stored at 4° C. The pH was re-checked immediately prior to use. High-salt sonication buffer (500 ml) contained 25 ml of 1M Hepes-KOH, pH 7.5; 35 ml of 5M NaCl; 1 ml of 0.5 M EDTA, pH 8.0; 50 ml of 10% Triton X-100; 10 ml of 5% Na-deoxycholate; and 5 ml of 10% SDS. The buffer was sterile-filtered, and stored at 4° C. The pH was re-checked immediately prior to use.

LiCl wash buffer (500 ml) contained 10 ml of 1M Tris-HCL, pH 8.0; 1 ml of 0.5M EDTA, pH 8.0; 125 ml of 1M LiCl solution; 25 ml of 10% NP-40; and 50 ml of 5% Na-deoxycholate. The pH was adjusted to 8.0. The buffer was sterile-filtered, and stored at 4° C. The pH was re-checked immediately prior to use.

Elution buffer (500 ml) used to quantify the amount of ChIP DNA contained 25 ml of 1M Tris-HCL, pH 8.0; 10 ml of 0.5M EDTA, pH 8.0; 50 ml of 10% SDS; and 415 ml of ddH$_2$O. The pH was adjusted to 8.0. The buffer was sterile-filtered, and stored at 4° C. The pH was re-checked immediately prior to use.

ChIA-PET Wash Buffer (50 ml) contains 500 µl of 1M Tris-HCl, pH 8.0 (final 10 mM); 100 µl of 0.5M EDTA, pH 8.0 (final 1 mM); 5 ml of 5M NaCl (final 500 mM); and 44.4 ml of dH$_2$O.

L. HiChIP

Alternatively to ChIA-PET, HiChIP was used to analyze chromatin interactions and conformation. HiChIP requires fewer cells than ChIA-PET.

i. Cell Crosslinking

Cells were cross-linked as described in the ChIP protocol above. Crosslinked cells were either stored as pellets at −80° C. or used for HiChIP immediately after flash-freezing the cells.

ii. Lysis and Restriction

Fifteen million cross-linked cells were resuspended in 500 µL of ice-cold Hi-C Lysis Buffer and rotated at 4° C. for 30 minutes. For cell amounts greater than 15 million, the pellet was split in half for contact generation and then recombined for sonication. Cells were spun down at 2500 g for 5 minutes, and the supernatant was discarded. The pelleted nuclei were washed once with 500 µL of ice-cold Hi-C Lysis Buffer. The supernatant was removed, and the pellet was resuspended in 100 µL of 0.5% SDS. The resuspension was incubated at 62° C. for 10 minutes, and then 285 µL of H2O and 50 µL of 10% Triton X-100 were added to quench the SDS. The resuspension was mixed well, and incubated at 37° C. for 15 minutes. Fifty µL of 10×NEB Buffer 2 and 375 U of MboI restriction enzyme (NEB, R0147) was added to the mixture to digest chromatin for 2 hours at 37° C. with rotation. For lower starting material, less restriction enzyme was used: 15 µL was used for 10-15 million cells, 8 µL for 5 million cells, and 4 µL for 1 million cells. Heat (62° C. for 20 minutes) was used to inactivate MboI.

iii. Biotin Incorporation and Proximity Ligation

To fill in the restriction fragment overhangs and mark the DNA ends with biotin, 52 µL of fill-in master mix was reacted by combining 37.5 µL of 0.4 mM biotin-dATP (Thermo 19524016); 1.5 µL of 10 mM dCTP, dGTP, and dTTP; and 10 µL of 5 U/µL DNA Polymerase I, Large (Klenow) Fragment (NEB, M0210). The mixture was incubated at 37° C. for 1 hour with rotation.

948 µL of ligation master mix was added. Ligation Master Mix contained 150 µL of 10×NEB T4 DNA ligase buffer with 10 mM ATP (NEB, B0202); 125 µL of 10% Triton X-100; 3 µL of 50 mg/mL BSA; 10 µL of 400 U/µL T4 DNA Ligase (NEB, M0202); and 660 µL of water. The mixture was incubated at room temperature for 4 hours with rotation. The nuclei were pelleted at 2500 g for 5 minutes, and the supernatant was removed.

iv. Sonication

For sonication, the pellet was brought up to 1000 µL in Nuclear Lysis Buffer. The sample was transferred to a Covaris millitube, and the DNA was sheared using a Covaris® E220Evolution™ with the manufacturer recommended parameters. Each tube (15 million cells) was sonicated for 4 minutes under the following conditions: Fill Level 5; Duty Cycle 5%; PIP 140; and Cycles/Burst 200.

v. Preclearing, Immunoprecipitation, IP Bead Capture, and Washes

The sample was clarified for 15 minutes at 16,100 g at 4° C. The sample was split into 2 tubes of about 400 µL each and 750 µL of ChIP Dilution Buffer was added. For the Smc1a antibody (Bethyl A300-055A), the sample was diluted 1:2 in ChIP Dilution Buffer to achieve an SDS concentration of 0.33%. 60 µL of Protein G beads were washed for every 10 million cells in ChIP Dilution Buffer. Amounts of beads (for preclearing and capture) and antibodies were adjusted linearly for different amounts of cell starting material. Protein G beads were resuspended in 50 µL of Dilution Buffer per tube (100 µL per HiChIP). The sample was rotated at 4° C. for 1 hour. The samples were put on a magnet, and the supernatant was transferred into new tubes. 7.5 µg of antibody was added for every 10 million cells, and the mixture was incubated at 4° C. overnight with rotation. Another 60 µL of Protein G beads for every 10 million cells in ChIP Dilution Buffer was added. Protein G beads were resuspended in 50 µL of Dilution Buffer (100 µL per HiChIP), added to the sample, and rotated at 4° C. for 2 hours. The beads were washed three times each with Low Salt Wash Buffer, High Salt Wash Buffer, and LiCl Wash Buffer. Washing was performed at room temperature on a magnet by adding 500 µL of a wash buffer, swishing the beads back and forth twice by moving the sample relative to the magnet, and then removing the supernatant vi. ChIP DNA Elution ChIP sample beads were resuspended in 100 µL of fresh DNA Elution Buffer. The sample beads were incubated at RT for 10 minutes with rotation, followed by 3 minutes at 37° C. with shaking. ChIP samples were placed on a magnet, and the supernatant was removed to a fresh tube. Another 100 μL of DNA Elution Buffer was added to ChIP samples and incubations were repeated. ChIP sample supernatants were removed again and transferred to a new tube. There was about 200 μL of ChIP sample. Ten μL of Proteinase K (20 mg/ml) was added to each sample and incubated at 55° C. for 45 minutes with shaking. The temperature was increased to 67° C., and the samples were incubated for at least 1.5 hours with shaking. The DNA was Zymo-purified (Zymo Research, #D4014) and eluted into 100 μL of water. Post-ChIP DNA was quantified to estimate the amount of Tn5 needed to generate libraries at the correct size distribution. This assumed that contact libraries were generated properly, samples were not over sonicated, and that material was robustly captured on streptavidin beads. SMC1 HiChIP with 10 million cells had an expected yield of post-ChIP DNA from 15 ng-50 ng. For libraries with greater than 150 ng of post-ChIP DNA, materials were set aside and a maximum of 150 ng was taken into the biotin capture step vii. Biotin Pull-Down and Preparation for Illumina Sequencing To prepare for biotin pull-down, 54, of Streptavidin C-1 beads were washed with Tween Wash Buffer. The beads were resuspended in 104, of 2× Biotin Binding Buffer and added to the samples. The beads were incubated at RT for 15 minutes with rotation. The beads were separated on a magnet, and the supernatant was discarded. The beads were washed twice by adding 500 μL of Tween Wash Buffer and incubated at 55° C. for 2 minutes while shaking. The beads were washed in 100 μL of 1×(diluted from 2×) TD Buffer. The beads were resuspended in 254, of 2× TD Buffer, 2.5 μL of Tn5 for each 50 ng of post-ChIP DNA, and water to a volume of 500 μL.

The Tn5 had a maximum amount of 4 μL. For example, for 25 ng of DNA transpose, 1.25 μL of Tn5 was added, while for 125 ng of DNA transpose, 40 μL of Tn5 was used. Using the correct amount of Tn5 resulted in proper size distribution. An over-transposed sample had shorter fragments and exhibited lower alignment rates (when the junction was close to a fragment end). An undertransposed sample has fragments that are too large to cluster properly on an Illumina sequencer. The library was amplified in 5 cycles and had enough complexity to be sequenced deeply and achieve proper size distribution regardless of the level of transposition of the library.

The beads were incubated at 55° C. with interval shaking for 10 minutes. Samples were placed on a magnet, and the supernatant was removed. Fifty mM EDTA was added to samples and incubated at 50° C. for 30 minutes. The samples were then quickly placed on a magnet, and the supernatant was removed. The samples were washed twice with 50 mM EDTA at 50° C. for 3 minutes, then were removed quickly from the magnet. Samples were washed twice in Tween Wash Buffer for 2 minutes at 55° C., then were removed quickly from the magnet. The samples were washed with 10 mM Tris-HCl, pH8.0.

viii. PCR and Post-PCR Size Selection

The beads were resuspended in 50 μL of PCR master mix (use Nextera XT DNA library preparation kit from Illumina, #15028212 with dual-Index adapters #15055289). PCR was performed using the following program. The cycle number was estimated using one of two methods: (1) A first run of 5 cycles (72° C. for 5 minutes, 98° C. for 1 minute, 98° C. for 15 seconds, 63° C. for 30 seconds, 72° C. for 1 minute) was performed on a regular PCR and then the product was removed from the beads. Then, 0.25×SYBR green was added, and the sample was run on a qPCR. Samples were pulled out at the beginning of exponential amplification; or (2) Reactions were run on a PCR and the cycle number was estimated based on the amount of material from the post-ChIP Qubit (greater than 50 ng was run in 5 cycles, while approximately 50 ng was run in 6 cycles, 25 ng was run in 7 cycles, 12.5 ng was run in 8 cycles, etc.).

Libraries were placed on a magnet and eluted into new tubes. The libraries were purified using a kit form Zymo Research and eluted into 10 μL of water. A two-sided size selection was performed with AMPure XP beads. After PCR, the libraries were placed on a magnet and eluted into new tubes. Then, 25 μL of AMPure XP beads were added, and the supernatant was kept to capture fragments less than 700 bp. The supernatant was transferred to a new tube, and 15 μL of fresh beads were added to capture fragments greater than 300 bp. A final elution was performed from the Ampure XP beads into 10 μL of water. The library quality was verified using a Bioanalyzer.

ix. Buffers

Hi-C Lysis Buffer (10 mL) contained 100 μL of 1M Tris-HCl pH 8.0; 20 μL of 5M NaCl; 200 μL of 10% NP-40; 200 μL of 50× protease inhibitors; and 9.68 mL of water. Nuclear Lysis Buffer (10 mL) contained 500 μL of 1M Tris-HCl pH 7.5; 200 μL of 0.5M EDTA; 1 mL of 10% SDS; 200 μL of 50× Protease Inhibitor; and 8.3 mL of water. ChIP Dilution Buffer (10 mL) contained 10 μL of 10% SDS; 1.1 mL of 10% Triton X-100; 24 μL of 500 mM EDTA; 167 μL of 1M Tris pH 7.5; 334 μL of 5M NaCl; and 8.365 mL of water. Low Salt Wash Buffer (10 mL) contained 100 μL of 10% SDS; 1 mL of 10% Triton X-100; 40 μL of 0.5M EDTA; 200 μL of 1M Tris-HCl pH 7.5; 300 μL of 5M NaCl; and 8.36 mL of water. High Salt Wash Buffer (10 mL) contained 100 μL of 10% SDS; 1 mL of 10% Triton X-100; 40 μL of 0.5M EDTA; 200 μL of 1M Tris-HCl pH 7.5; 1 mL of 5M NaCl; and 7.66 mL of water. LiCl Wash Buffer (10 mL) contained 100 μL of 1M Tris pH 7.5; 500 μL of 5M LiCl; 1 mL of 10% NP-40; 1 mL of 10% Na-deoxycholate; 20 μL of 0.5M EDTA; and 7.38 mL of water.

DNA Elution Buffer (5 mL) contained 250 μL of fresh 1M NaHCO$_3$; 500 μL of 10% SDS; and 4.25 mL of water. Tween Wash Buffer (50 mL) contained 250 μL of 1M Tris-HCl pH 7.5; 50 μL of 0.5M EDTA; 10 mL of 5M NaCl; 250 μL of 10% Tween-20; and 39.45 mL of water. 2× Biotin Binding Buffer (10 mL) contained 100 μL 1M Tris-HCl pH 7.5; 20 μL of 0.5M; 4 mL of 5M NaCl; and 5.88 mL of water. 2×TD Buffer (1 mL) contains 20 μL of 1M Tris-HCl pH 7.5; 10 μL of 1M MgCl$_2$; 200 μL of 100% Dimethylformamide; and 770 μL of water.

M. Drug Dilutions for Administration to Hepatocytes

Prior to compound treatment of hepatocytes, 100 mM stock drugs in DMSO were diluted to 10 mM by mixing 0.1 mM of the stock drug in DMSO with 0.9 ml of DMSO to a final volume of 1.0 ml. Five μl of the diluted drug was added to each well, and 0.5 ml of media was added per well of drug. Each drug was analyzed in triplicate. Dilution to 1000× was performed by adding 5 μl of drug into 45 μl of media, and the 50 μl being added to 450 μl of media on cells.

Bioactive compounds were also administered to hepatocytes. To obtain 1000× stock of the bioactive compounds in 1 ml DMSO, 0.1 ml of 10,000× stock was combined with 0.9 ml DMSO.

Example 2. RNA-Seq Study for Stimulated Hepatocytes

To identify small molecules that modulate urea cycle enzymes, primary human hepatocytes were prepared as a monoculture, and at least one small molecule compound was applied to the cells.

RNA-seq was performed to determine the effects of the compounds on the expression of urea cycle enzymes in hepatocytes. Fold change was calculated by dividing the level of expression in the cell system that had been perturbed by the level of expression in an unperturbed system. Changes in expression having a p-value ≤0.05 were considered significant.

Compounds used to perturb the signaling centers of hepatocytes include at least one compound listed in Table 1. In the table, compounds are listed with their ID, target, pathway, and pharmaceutical action. Most compounds chosen as perturbation signals are known in the art to modulate at least one canonical cellular pathway. Some compounds were selected from compounds that failed in Phase III clinical evaluation due to lack of efficacy.

TABLE 1

Compounds used in RNA-seq

| ID | Compound Name | Target | Pathway | Action |
|---|---|---|---|---|
| 1 | Simvastatin | HMG-CoA reductase | Metabolic | Inhibitor |
| 2 | Adapin (doxepin) | $H_1$ histamine, α-adrenoreceptors | Histamine receptor signaling | Antagonist |
| 4 | Danazol | ER, AR, Progesteron receptor | Estrogen signaling | Agonist |
| 5 | Nefazodone | HTR2A | Calcium signaling | Antagonist |
| 6 | Rosiglitazone maleate | PPARg | PPAR signaling | Agonist |
| 7 | Sulpiride | $D_2$ dopamine | cAMP signaling | Antagonist |
| 8 | Captopril | MMP2 | Estrogen signaling | Inhibitor |
| 9 | atenolol | ADRB1 | Adrenergic signaling | Antagonist |
| 10 | Ranitidine | $H_2$ histamine receptor | Histamine receptor signaling | Antagonist |
| 11 | Metformin | AMPK | Insulin & AMPK signaling | Activator |
| 12 | imatinib | RTK, Bcr-Abl | PDGFR, ABL signaling | Inhibitor |
| 13 | Papaverine | phosphodiesterase | AMPK signaling | Inhibitor |
| 14 | Amiodarone | Adrenergic receptor β, CYP | Adrenergic signaling | Antagonist |
| 15 | Nitrofurantoin | pyruvate-flavodoxin oxidoreductase | antibiotic | Activator |
| 16 | prednisone | GR | GR signaling | Agonist |
| 17 | Penicillamine(D-) | copper | copper chelation | Chelator |
| 18 | Disopyramide | SCN5A | Adrenergic signaling | Inhibitor |
| 19 | Rifampicin | PXR | PXR | Inhibitor |
| 20 | Benzbromarone | xanthine oxidase, CYP2C9 | uric acid formation | Inhibitor |
| 21 | isoniazid | CYP2C19, CYP3A4 | unknown | Inhibitor |
| 22 | Acetaminophen (paracetamol) | COX1/2 | COX | Inhibitor |
| 23 | Ritonavir | CYP3A4, Pol polyprotein | HIV Transcription | Inhibitor |
| 24 | SGI-1776 | PIM | JAK/STAT signaling | Inhibitor |
| 25 | Valproate | HDAC9, glucuronyl transferase, epoxide hydrolase | unknown | Inhibitor |
| 26 | Ibuprofen | COX, PTGS2 | COX | Inhibitor |
| 27 | Propylthiouracil | thyroperoxidase | Thyroid hormone synthesis | Inhibitor |
| 28 | rapamycin | mTOR | mTOR signaling | Inhibitor |
| 29 | BIO | GSK-3 | WNT, TGF beta signaling | Inhibitor |
| 30 | ATRA | RXRb, RXRg, RARg | RAR signaling | Agonist |
| 31 | Xav939 | tankyrase | WNT & PARP pathway | Inhibitor |
| 32 | bms189453 | RARB | Nuclear Receptor transcription | Agonist |
| 33 | dorsomorphin | ALK | TGF beta signaling | Inhibitor |
| 34 | BMP2 | BMPR1A | TGF beta signaling | Agonist |
| 35 | BMS777607 | Met | Ras signaling | Inhibitor |
| 36 | bms833923 | SMO | Hedgehog signaling | Antagonist |
| 37 | dmPGE2 | EPR, PGDH | EP receptor signaling | Agonist |
| 38 | MK-0752 | γ-secretase | NOTCH signaling | Inhibitor |
| 39 | N-Acetylpurinomycin | SnoN, SKI, SKIL | TGF beta signaling | Modulator |
| 40 | LY 364947 | TGF-β RI, TGFR-I, TβR-I, ALK-5 | TGF beta signaling | Inhibitor |
| 41 | Enzastaurin | PKC | Epigenetics; TGF-beta/Smad | Inhibitor |
| 42 | DMXAA | Unclear | Tumor necrosis | Inhibitor |
| 43 | BSI-201 | PARP | Cell Cycle/DNA Damage; Epigenetics | Inhibitor |
| 44 | Darapladib | Phospholipase | Others | Inhibitor |
| 45 | Selumetinib | MEK | MAPK/ERK Pathway | Inhibitor |
| 46 | Peramivir (trihydrate) | Influenza Virus | Anti-infection | Inhibitor |
| 47 | Palifosfamide | DNA alkylator/crosslinker | Cell Cycle/DNA Damage | |
| 48 | Evacetrapib | CETP | Others | Inhibitor |
| 49 | Cediranib | VEGFR | Protein Tyrosine Kinase/RTK | Inhibitor |
| 50 | R788 (fostamatinib, disodium hexahydrate) | Syk | Protein Tyrosine Kinase/RTK | Inhibitor |
| 51 | Torcetrapib | CETP | Others | Inhibitor |
| 52 | Tivozanib | VEGFR | Protein Tyrosine Kinase/RTK | Inhibitor |
| 53 | 17-AAG (Tanespimycin) | HSP | Cell Cycle/DNA Damage Metabolic Enzyme/Protease | Inhibitor |

TABLE 1-continued

Compounds used in RNA-seq

| ID | Compound Name | Target | Pathway | Action |
|---|---|---|---|---|
| 54 | Zibotentan | Endothelin Receptor | GPCR/G protein | Antagonist |
| 55 | Semagacestat | γ-secretase | Neuronal Signaling Stem Cells/Wnt | Inhibitor |
| 56 | Dalcetrapib | CETP | Others | Inhibitor |
| 57 | Latrepirdine (dihydrochloride) | AMPK | Epigenetics; PI3K/Akt/mTOR | Activator |
| 58 | CMX001 (Brincidofovir) | CMV | Anti-infection | NA |
| 59 | Vicriviroc (maleate) | CCR | GPCR/G protein; Immunology/Inflammation | Antagonist |
| 60 | Temsirolimus | mTOR | PI3K/Akt/mTOR | Inhibitor |
| 61 | Preladenant | Adenosine Receptor | GPCR/G protein | Antagonist |
| 62 | EVP-6124 (hydrochloride) (encenicline) | nAChR | Membrane Transporter/Ion Channel | Activator |
| 63 | Bitopertin | GlyT1 | Membrane Transporter/Ion Channel | Inhibitor |
| 64 | Latrepirdine | AMPK | Epigenetics; PI3K/Akt/mTOR | Inhibitor |
| 65 | Vanoxerine (dihydrochloride) | Dopamine Reuptake Inhibitor | Neuronal Signaling | Inhibitor |
| 66 | CO-1686 (Rociletinib) | EGFR | JAK/STAT Signaling Protein Tyrosine Kinase/RTK | Inhibitor |
| 67 | Laropiprant (tredaptive) | Prostaglandin Receptor | GPCR/G protein | Antagonist |
| 68 | Bardoxolone | Keap1-Nrf2 | NF-κB | Activator |
| 69 | VX-661 (tezacaptor) | CFTR | Membrane transporter/ion channel | Corrector |
| 70 | INNO-206 (aldoxorubicin) | Topoisomerase | Cell Cycle/DNA Damage | NA |
| 71 | LY404039 (pomaglumetad methionil (mGlu2/3)) | mGluR | GPCR/G protein | Inhibitor |
| 72 | Perifosine (KRX-0401) | AKT | PI3K/AKT | Inhibitor |
| 73 | Cabozantinib (XL184, BMS-907351) | VEGFR2, MET, Ret, Kit, Flt-1/3/4, Tie2, and AXL | MET | Inhibitor |
| 74 | Dacomitinib (PF299804, PF299) | EGFR, ErbB2, ErbB4 | AKT/ERK, HER | Inhibitor |
| 75 | Pacritinib (SB1518) | FLT3, JAK2, TYK2, JAK3, JAK1 | JAK-STAT | Inhibitor |
| 76 | TH-302 (Evofosfamide) | hypoxic regions | Unclear | NA |
| 77 | α-PHP | Unclear | Unclear | NA |
| 78 | LY 2140023 (Pomaglumetad methionil-LY404039) | mGlu$_2$ & mGlu$_3$ | Gαi/o protein-dependent | Activator |
| 79 | TP-434 (Eravacycline) | Antibiotic resistance mechanisms | Tetracycline-specific efflux | Inhibitor |
| 80 | TC-5214 (S-(+)-MecaMylaMine Hydrochloride) | Nicotinic acetylcholine receptors | Base excision repair and homologous recombination repair | Antagonist |
| 81 | Rolofylline (KW-3902) | A1 adenosine receptor | Unclear | Antagonist |
| 82 | Amigal (Deoxygalactonojirimycin hydrochloride) | a-galactosidase | Stress signaling | Inhibitor |
| 83 | NOV-002 (oxidized L-Glutathione) | gamma-glutamyl-transpeptidase (GGT) | Glutathione pathway | NA |
| 84 | bms-986094 (inx-189) | NS5B | Unclear | Inhibitor |
| 85 | TC-5214 (R-Mecamylamine hydrochloride) | Nicotinic receptors | Base excision repair and homologous recombination repair | Antagonist |
| 86 | Ganaxolone | GBAA receptors | Unclear | Modulator |
| 87 | Irinotecan Hydrochloride Trihydrate | DNA Topo I | Unclear | Inhibitor |
| 88 | TFP | D2R, Calmodulin | Calmodulin | Inhibitor |
| 89 | Perphenazine | D2R, Calmodulin | Calmodulin | Inhibitor |
| 90 | A3-HCl | CKI, CKII, PKC, PKA | WNT, Hedgehog, PKC, PKA | Inhibitor |
| 91 | FICZ | Aryl hydrocarbon receptor | Aryl hydrocarbon receptor | Agonist |
| 92 | Pifithrin-a | p53 | p53 | Inhibitor |
| 93 | Deferoxamine mesylate | HIF | Hypoxia activated | Inhibitor |
| 94 | Insulin | InsR | IGF-1R/InsR | Activator |
| 95 | Phorbol 12,13-dibutymte | PKC | PKC | Activator |

TABLE 1-continued

Compounds used in RNA-seq

| ID | Compound Name | Target | Pathway | Action |
|---|---|---|---|---|
| 96 | RU 28318 | MR | Mineralcorticoid receptor | Antagonist |
| 97 | Bryostatin1 | PKC | PKC | Activator |
| 98 | DY 268 | FXR | FXR | Antagonist |
| 99 | GW 7647 | PPARα | PPAR | Agonist |
| 100 | CI-4AS-1 | AR | Androgen receptor | Agonist |
| 101 | T0901317 | LXR | LXR | Agonist |
| 102 | BMP2 | BMPR1A | TGF-B | Activator |
| 103 | 22S-Hydroxycholesterol | LXR | LXR | Inhibitor |
| 104 | CALP1 | Calmodulin | Calmodulin | Activator |
| 105 | CALP3 | Calmodulin | Calmodulin | Activator |
| 106 | Forskolin | Adenylyl cyclase | cAMP related | Activator |
| 107 | Dexamethasone | GR | Glucocorticoid receptor | Activator |
| 108 | IFN-y | IFNGR1/IFNGR2 | JAK/STAT | Activator |
| 109 | TGF-b | TGF-beta Receptor | TGF-B | Activator |
| 110 | TNF-α | TNF-R1/TNF-R2 | NF-kB, MAPK, Apoptosis | Activator |
| 111 | PDGF | Pan-PDGFR | PDGFR | Activator |
| 112 | IGF-1 | IGF-1R | IGF-1R/InsR | Activator |
| 113 | FGF | FGFR | FGFR | Activator |
| 114 | EGF | Pan-ErbB | EGFR | Activator |
| 115 | HGF/SF | c-Met | c-MET | Activator |
| 116 | TCS 359 | FLT3 | Protein Tyrosine Kinase/RTK | Inhibitor |
| 117 | Cobalt chloride | HIF1 | Hypoxia activated | Inducer |
| 118 | CH223191 | AhR | Aryl hydrocarbon receptor | Antagonist |
| 119 | Echinomycin | HIF | Hypoxia activated | Inhibitor |
| 120 | PAF C-16 | MEK | MAPK | Activator |
| 121 | Bexarotene | RXR | RXR | Agonist |
| 122 | CD 2665 | RAR | RAR | Antagonist |
| 123 | Pifithrin-μ | p53 | p53 | Inhibitor |
| 124 | EB1089 | VDR | Vitamin D Receptor | Agonist |
| 125 | BMP4 | TGF-beta | TGF-B | Activator |
| 126 | IWP-2 | Wnt | WNT | Inhibitor |
| 127 | RITA (NSC 652287) | p53 | p53 | Inhibitor |
| 128 | Calcitriol | VDR | Vitamin D Receptor | Agonist |
| 129 | ACEA | CB1 | Cannabinoid receptor | Agonist |
| 130 | Rimonabant | CB1 | Cannabinoid receptor | Antagonist |
| 131 | Otenabant | CB1 | Cannabinoid receptor | Antagonist |
| 132 | DLPC | LRH-1/NR5A2 | LHR-1 | Agonist |
| 133 | LRH-1 antagonist | LRH-1/NR5A3 | LHR-1 | Antagonist |
| 134 | Wnt3a | FRIZZLED | WNT | Activator |
| 135 | Activin | TGF-beta | TGF-B | Activator |
| 136 | Nodal | TGF-beta | TGF-B | Activator |
| 137 | Anti mullerian hormone | TGF-beta | TGF-B | Activator |
| 138 | GDF2 (BMP9) | TGF-beta | TGF-B | Activator |
| 139 | GDF10 (BMP3b) | TGF-beta | TGF-B | Activator |
| 140 | Oxoglaucine | PI3K/Akt | PI3K/AKT | Activator |
| 141 | BMS 195614 | RAR | RAR | Antagonist |
| 142 | LDN193189 | ALK2/3 | TGF-B | Inhibitor |
| 143 | Varenicline Tartrate | AchR | Acetylcholine receptor | Agonist |
| 144 | Histamine | Histamine receptor | Histamine receptor | Activator |
| 145 | Chloroquine phosphate | ATM/ATR | ATM/ATR | Activator |
| 146 | LJI308 | RSK1/2/3 | S6K | Inhibitor |
| 147 | GSK621 | AMPK | AMPK | Activator |
| 148 | STA-21 | STAT3 | JAK/STAT | Inhibitor |
| 149 | SMI-4a | Pim1 | PIM | Inhibitor |
| 150 | AMG 337 | c-Met | c-MET | Inhibitor |
| 151 | Wnt agonist 1 | Wnt | WNT | Activator |
| 152 | PRI-724 | Wnt | WNT | Inhibitor |
| 153 | ABT-263 | Pan-Bcl-2 | BCL2 | Inhibitor |
| 154 | Axitinib | Pan-VEGFR | VEGFR | Inhibitor |
| 155 | Afatinib | Pan-ErbB | EGFR | Inhibitor |
| 156 | Bosutinib | Src | Src | Inhibitor |
| 157 | Dasatinib | Bcr-Abl | ABL | Inhibitor |
| 158 | Masitinib | c-Kit | c-KIT | Inhibitor |
| 159 | Crizotinib | c-Met | c-MET | Inhibitor |
| 160 | PHA-665752 | c-Met | c-MET | Inhibitor |
| 161 | GSK1904529A | IGF-1R/InsR | IGF-1R/InsR | Inhibitor |
| 162 | GDC-0879 | Raf | MAPK | Inhibitor |
| 163 | LY294002 | Pan-PI3K | PI3K/AKT | Inhibitor |
| 164 | OSU-03012 | PDK-1 | PDK-1 | Inhibitor |
| 165 | JNJ-38877605 | c-Met | c-MET | Inhibitor |
| 166 | BMS-754807 | IGF-1R/InsR | IGF-1R/InsR | Inhibitor |
| 167 | TGX-221 | p110b | PI3K/AKT | Inhibitor |
| 168 | Regorafenib | Pan-VEGFR | VEGFR | Inhibitor |

TABLE 1-continued

Compounds used in RNA-seq

| ID | Compound Name | Target | Pathway | Action |
|---|---|---|---|---|
| 169 | Thalidomide | AR | NF-kB | Antagonist |
| 170 | Amuvatinib | PDGFRA | PDGFR | Inhibitor |
| 171 | Etomidate | GABA | GABAergic receptor | Inhibitor |
| 172 | Glimepiride | Potassium channel | Potassium channel | Inhibitor |
| 173 | Omeprazole | Proton pump | Proton pump | Agonist |
| 174 | Tipifarnib | Ras | RAS | Inhibitor |
| 175 | SP600125 | Jnk | MAPK | Inhibitor |
| 176 | Quizartinib | FLT3 | FLT3 | Inhibitor |
| 177 | CP-673451 | Pan-PDGFR | PDGFR | Inhibitor |
| 178 | Pomalidomide | TNF-α | NF-kB | Inhibitor |
| 179 | KU-60019 | ATM kinase | DNA Damage | Inhibitor |
| 180 | BIRB 796 | p38 | MAPK | Inhibitor |
| 181 | RO4929097 | Gamma-secretase | NOTCH | Inhibitor |
| 182 | Hydrocortisone | GR | Glucocorticoid receptor | Agonist |
| 183 | AICAR | AMPK | AMPK | Activator |
| 184 | Amlodipine Besylate | Calcium channel | Calcium channel | Inhibitor |
| 185 | DPH | Bcr-Abl | ABL | Activator |
| 186 | Taladegib | Hedgehog/Smoothened | Hedgehog/Smoothened | Inhibitor |
| 187 | AZD1480 | JAK2 | JAK/STAT | Inhibitor |
| 188 | AST-1306 | Pan-ErbB | EGFR | Inhibitor |
| 189 | AZD8931 | Pan-ErbB | EGFR | Inhibitor |
| 190 | Momelotinib | Pan-Jak | JAK/STAT | Inhibitor |
| 191 | Cryptotanshinone | STAT3 | JAK/STAT | Inhibitor |
| 192 | Bethanechol chloride | AchR | Acetylcholine receptor | Activator |
| 193 | Clozapine | 5-HT | 5-HT | Antagonist |
| 194 | Dopamine | Dopamine | Dopamine receptor | Agonist |
| 195 | Phenformin | AMPK | AMPK | Activator |
| 196 | Mifepristone | GR | Glucocorticoid receptor | Antagonist |
| 197 | GW3965 | LXR | LXR | Agonist |
| 198 | WYE-125132 (WYE-132) | mTOR | mTOR | Inhibitor |
| 199 | Crenolanib | Pan-PDGFR | PDGFR | Inhibitor |
| 200 | PF-04691502 | Pan-Akt | PI3K/AKT | Inhibitor |
| 201 | GW4064 | FXR | FXR | Agonist |
| 202 | Sotrastaurin | PKC | PKC | Inhibitor |
| 203 | Ipatasertib | Pan-Akt | PI3K/AKT | Inhibitor |
| 204 | ARN-509 | AR | Androgen receptor | Inhibitor |
| 205 | T0070907 | PPARg | PPAR | Antagonist |
| 206 | GO6983 | PKC | PKC | Inhibitor |
| 207 | Epinephrine | Adrenergic | Adrenergic receptor | Agonist |
| 208 | Eletriptan | 5-HT | 5-HT | Agonist |
| 209 | Trifluoperazine | Dopamine | Dopamine receptor | Inhibitor |
| 210 | Fexofenadine | Histamine | Histamine receptor | Inhibitor |
| 211 | Deoxycorticosterone | MR | Mineralcorticoid receptor | Agonist |
| 212 | Tamibarotene | RAR | RAR | Agonist |
| 213 | Leucine | mTOR | mTOR | Activator |
| 214 | Glycopyrrolate | AchR | Acetylcholine receptor | Antagonist |
| 215 | Tiagabine | GABA | GABAergic receptor | Inhibitor |
| 216 | Fluoxymesterone | AR | Androgen receptor | Agonist |
| 217 | Tamsulosin hydrochloride | Adrenergic | Adrenergic receptor | Antagonist |
| 218 | Ceritinib | ALK | ALK | Inhibitor |
| 219 | GSK2334470 | PDK-1 | PDK-1 | Inhibitor |
| 220 | AZD1208 | Pan-PIM | PIM | Inhibitor |
| 221 | CGK733 | ATM/ATR | DNA Damage | Inhibitor |
| 222 | LDN-212854 | Pan-TGFB | TGF-B | Inhibitor |
| 223 | GZD824 Dimesylate | Bcr-Abl | ABL | Inhibitor |
| 224 | AZD2858 | Pan-GSK-3 | GSK-3 | Inhibitor |
| 225 | FRAX597 | PAK | PAK | Inhibitor |
| 226 | SC75741 | NF-kB | NF-kB | Inhibitor |
| 227 | SH-4-54 | Pan-STAT | JAK/STAT | Inhibitor |
| 228 | HS-173 | p110a | PI3K/AKT | Inhibitor |
| 229 | K02288 | Pan-TGFB | TGF-B | Inhibitor |
| 230 | EW-7197 | Pan-TGFB | TGF-B | Inhibitor |
| 231 | Decernotinib | Pan-Jak | JAK/STAT | Inhibitor |
| 232 | MI-773 | p53 | p53 | Inhibitor |
| 233 | PND-1186 | FAK | FAK | Activator |
| 234 | Kartogenin | SMAD4/5 | TGF-B | Activator |
| 235 | Picropodophyllin | IGF-1R | IGF-1R/InsR | Inhibitor |
| 236 | AZD6738 | ATR | ATM/ATR | Inhibitor |
| 237 | Smoothened Agonist | Hedgehog/Smoothened | Hedgehog/Smoothened | Agonist |
| 238 | Erlotinib | EGFR/ErbB1 | EGFR | Inhibitor |
| 239 | MHY1485 | mTOR | mTOR | Activator |
| 240 | SC79 | Pan-Akt | PI3K/AKT | Activator |
| 241 | meBIO | AhR | Aryl hydrocarbon receptor | Agonist |
| 242 | Huperzine | AchE | Acetylcholine receptor | Inhibitor |

TABLE 1-continued

Compounds used in RNA-seq

| ID | Compound Name | Target | Pathway | Action |
|---|---|---|---|---|
| 243 | BGJ398 | Pan-FGFR | FGFR | Inhibitor |
| 244 | Netarsudil | ROCK | ROCK | Inhibitor |
| 245 | Acetycholine | AchR | Acetylcholine receptor | Agonist |
| 246 | Purmorphamine | Hedgehog/Smoothened | Hedgehog/Smoothened | Agonist |
| 247 | LY2584702 | p 70 S6K | S6K | Inhibitor |
| 248 | Dorsomorphin | AMPK | AMPK | Inhibitor |
| 249 | Glasdegib (PF-04449913) | Hedgehog/Smoothened | Hedgehog/Smoothened | Inhibitor |
| 250 | LDN193189 | Pan-TGFB | TGF-B | Inhibitor |
| 251 | Oligomycin A | ATPase | ATP channel | Inhibitor |
| 252 | BAY 87-2243 | HIF1 | Hypoxia activated | Inhibitor |
| 253 | SIS3 | SMAD3 | TGF-B | Inhibitor |
| 254 | BDA-366 | Bcl-2 | BCL2 | Antagonist |
| 255 | XMU-MP-1 | MST1/2 | Hippo | Inhibitor |
| 256 | Semaxanib | Pan-VEGFR | VEGFR | Inhibitor |
| 257 | BAM7 | Bcl-2 | BCL2 | Activator |
| 258 | GDC-0994 | Erk | MAPK | Inhibitor |
| 259 | SKL2001 | Wnt | WNT | Agonist |
| 260 | Merestinib | c-Met | c-MET | Inhibitor |
| 261 | APS-2-79 | MEK | MAPK | Antagonist |
| 262 | NSC228155 | Pan-ErbB | EGFR | Activator |
| 263 | 740 Y-P | Pan-PI3K | PI3K/AKT | Activator |
| 264 | b-Estradiol | ER | ER | Activator |
| 265 | Glucose | GLUTs | metabolic/glycolysis | Activator |
| 266 | Transferrin | Transferrin Receptor | Iron transport | Activator |
| 267 | AM 580 | RAR | RAR | Activator |

Example 3. Identification of Compounds that Modulate Expression of Urea Cycle Enzymes Analysis of RNA-seq data revealed a number of compounds that caused significant changes in the expression of CPS1, OTC, ASS1, ASL, and/or NAGS. Significance was defined as an FPKM ≥1, a log 2 (fold change) ≥0.5, and a q-value of ≤0.05 for selected gene target. RNA-seq results for compounds that significantly modulated at least one target gene are shown in Tables 2-10. Table 2 provides the log 2 fold change for compounds that were observed to significantly increase the expression of CPS1, which is associated with CPS deficiency.

TABLE 2

CPS1 expression modulated by compounds

| ID | Compound | Fold change (Log 2) vs untreated |
|---|---|---|
| 157 | Dasatinib | 6.44 |
| 50 | R788 (fostamatinib disodium hexahydrate) | 5.93 |
| 156 | Bosutinib | 5.06 |
| 207 | Epinephrine | 4.85 |
| 225 | FRAX597 | 4.61 |
| 260 | Merestinib | 3.96 |
| 211 | Deoxycorticosterone | 3.79 |
| 53 | 17-AAG (Tanespimycin) | 3.73 |
| 138 | GDF2 (BMP9) | 3.46 |
| 223 | GZD824 Dimesylate | 3.39 |
| 233 | PND-1186 | 2.85 |
| 134 | Wnt3a | 2.6 |
| 136 | Nodal | 2.44 |
| 137 | Anti mullerian hormone | 2.35 |
| 110 | TNF-α | 2.31 |
| 135 | Activin | 2.23 |
| 112 | IGF-1 | 2.22 |
| 16 | prednisone | 2.17 |
| 111 | PDGF | 2.12 |
| 115 | HGF/SF | 2.02 |
| 114 | EGF | 1.93 |
| 252 | BAY 87-2243 | 1.81 |
| 177 | CP-673451 | 1.77 |
| 113 | FGF | 1.72 |
| 139 | GDF10 (BMP3b) | 1.66 |
| 250 | LDN193189 | 1.56 |
| 170 | Amuvatinib | 1.46 |
| 190 | Momelotinib | 1.46 |
| 119 | Echinomycin | 1.45 |
| 75 | Pacritinib (SB1518) | 1.33 |
| 102 | BMP2 | 1.31 |
| 159 | Crizotinib | 1.08 |
| 222 | LDN-212854 | 1.08 |
| 169 | Thalidomide | 1.02 |
| 66 | CO-1686 (Rociletinib) | 0.89 |
| 54 | Zibotentan | 0.81 |

Table 3 provides the log 2 fold change for compounds that were observed to significantly increase the expression of OTC, which is associated with OTC deficiency.

TABLE 3

OTC expression modulated by compounds

| ID | Compound | Fold change (Log 2) vs untreated |
|---|---|---|
| 177 | CP-673451 | 2.63 |
| 75 | Pacritinib (SB1518) | 2.33 |
| 119 | Echinomycin | 2.08 |
| 199 | Crenolanib | 1.23 |
| 169 | Thalidomide | 1.21 |
| 170 | Amuvatinib | 1.15 |
| 157 | Dasatinib | 1.06 |
| 190 | Momelotinib | 0.95 |

TABLE 3-continued

OTC expression modulated by compounds

| ID | Compound | Fold change (Log 2) vs untreated |
|---|---|---|
| 135 | Activin | 0.94 |
| 134 | Wnt3a | 0.92 |
| 70 | INNO-206 (aldoxorubicin) | 0.87 |
| 110 | TNF-α | 0.87 |
| 137 | Anti mullerian hormone | 0.81 |
| 123 | Pifithrin-μ | 0.79 |
| 111 | PDGF | 0.77 |
| 112 | IGF-1 | 0.76 |
| 225 | FRAX597 | 0.69 |
| 136 | Nodal | 0.68 |
| 114 | EGF | 0.64 |
| 113 | FGF | 0.56 |
| 115 | HGF/SF | 0.56 |
| 180 | BIRB 796 | 0.56 |

Table 3A provides additional data for compounds that were observed to increase the expression of OTC, which is associated with OTC deficiency. Compounds assayed at 10 uM final concentration, except for compounds HSP-990 and Retaspimycin Hydrochloride which were assayed at 1 uM final concentration.

TABLE 3A

OTC expression modulated by compounds

| ID | Name/Company | MoA | Max Value (OTC/GeoMean of HKs; DMSO = 1) |
|---|---|---|---|
| 248 | Dorsomorphin | AMPK and BMPR1 | 4.78 |
| 600 | Foretinib (GSK1363089) | c-Met, VEGFR | 4.09 |
| 327 | CCCP | TBK1/IRF3 | 4.06 |
| 190 | Momelotinib | JAK | 3.52 |
| 630 | PF-00562271 | FAK | 3.3 |
| 626 | Mubritinib (TAK 165) | HER2 | 3.23 |
| 316 | XL228 | BCR-Abl, IGF-1R | 2.92 |
| 551 | Sunitinib | PDGFR | 2.62 |
| 180 | BIRB 796 | p 38 MAPK & JNK2 | 2.61 |
| 326 | BX795 | TBK1 | 2.57 |
| 70 | Aldoxorubicin | Doxorubicin prodrug | 2.36 |
| 673 | BMS-214662 | Farnesyl Transferase Inhibitor | 2.27 |
| 654 | Lifirafenib (BGB-283) | Raf, EGFR | 2.26 |
| 685 | Pamapimod | p 38 MAPK | 1.73 |
| 323 | PF-04929113 (SNX-5422) | HSP90 & HER2 | 1.73 |
| 53 | 17-AAG | HSP90 & HER2 | 1.69 |
| 320 | BIIB021 | HSP90 | 1.66 |
| 277 | Baricitinib | JAK 1 & 2 | 1.66 |
| 170 | Amuvatinib | PDGFA | 3.21 |
| 199 | Crenolanib | Pan-PDGFR | 2.79 |
| 497 | Pazopanib | c-Kit, PDGFR, VEGFR | 1.48 |
| 322 | HSP-990 | HSP90 | 1.5 (compound tested at 1 uM) |
| 925 | Retaspimycin Hydrochloride | HSP90 ATPase | 1.48 (compound tested at 1 uM) |
| 187 | AZD1480 | JAK2 | 1.46 |
| 325 | MRT67307 | TBK1 | 1.68 |
| 68 | Bardoxolone | NF-κB | 2.76 |
| 177 | CP-673451 | Pan-PDGFR | 3.97 |
| 313 | Tofacitinib citrate | JAK1 & 2 | 1.6 |
| 311 | LY2784544 | JAK2 | 2.78 |
| 684 | R1487 Hydrochloride | p 38 MAPK | 1.64 |
| 52 | Tivozanib | VEGFR 1/2/3 | 1.57 |
| 268 | Regorafenib | Pan-VEGFR | 1.54 |
| 300 | GLPG0634 | Pan-JAK | 1.54 |
| 632 | PH-797804 | p 38 MAPK | 1.53 |
| 55 | Semagacestat | β-amyloid & Notch | 1.5 |
| 71 | Pomaglumetad | mGlu2/mGlu3 (agonist | 1.49 |
| 253 | SIS3 | SMAD3 (TGFB) | 1.46 |
| 587 | Linifanib (ABT-869) | CSF-1R, PDGFR, VEGFR | 2.87 |
| 609 | Regorafenib (BAY 73-4506) | VEGFR, PDGFRβ | 2.07 |
| 631 | TAK-901 | Aurora Kinase | 2.9 |
| 919 | AS602801 (Bentamapimod) | JNK | 2.75 |
| 603 | YM155 (Sepantronium Bromide) | Survivin | 3.16 |

Example 4. Use of siRNA Agents to Up-Regulate OTC Expression

Primary human hepatocytes were reversed transfected with 6 pmol siRNA using RNAiMAX Reagent (ThermoFisher Cat No13778030) in 24 well format, 1 ul per well (for a final cone of 10 nM). The following morning, the medium was removed and replaced with Modified Maintenance Medium (see above) for an additional 24 hrs. The entire treatment lasted 48 hrs, at which point the medium was removed and replaced with RLT Buffer for RNA extraction (Qiagen RNeasy 96 QIAcube HT Kit Cat #74171). siRNAs were obtained from Dharmacon and are a pool of four siRNA duplex all designed to target distinct sites within the specific gene of interest (known as "SMARTpool"). The siRNA catalog numbers are listed in Table 3B, below. They were tested against the control non-targeting siRNA D-001206-13-05.

Isolated RNA was processed for cDNA synthesis and qPCR as described above. Taqman assay used for OTC measurement: Hs00166892_ml

TABLE 3B siRNA Agents up-regulate OTC

| siRNA | Max fold change in OTC | Catalog Number |
|---|---|---|
| JAK1 | 3.51 | M-003145-02-0005 |
| WWTR1 | 3.43 | M-016083-00-0005 |
| YAP1 | 2.93 | M-046247-01-0005 |
| CSF1R | 2.80 | D-003109-06 |
| LYN | 2.51 | D-003153-03 |
| SMAD3 | 2.49 | M-020067-00-0005 |
| NTRK1 | 2.25 | D-003159-05 |

TABLE 3B-continued siRNA Agents up-regulate OTC

| siRNA | Max fold change in OTC | Catalog Number |
|---|---|---|
| EPHB3 | 2.23 | D-003123-09 |
| EPHB4 | 2.21 | D-003124-05 |
| FGFR4 | 2.16 | D-003134-05 |
| INSR | 2.13 | D-003014-05 |
| KDR | 2.12 | D-003148-05 |
| FLT1 | 2.09 | D-003136-05 |
| FGFR2 | 2.07 | D-003132-05 |
| EPHB2 | 1.91 | D-003122-07 |
| PDGFRB | 1.90 | M-003163-03-0005 |
| IRF5 | 1.90 | M-011706-00-0005 |
| FGFR1 | 1.87 | D-003131-09 |
| EPHB1 | 1.85 | D-003121-05 |
| FYN | 1.81 | D-003140-09 |
| FLT4 | 1.71 | D-003138-05 |
| Yy1 | 1.71 | M-011796-02-0005 |
| IRF1 | 1.70 | M-011704-01-0005 |
| IGF-1 | 1.69 | D-003012-06 |
| SMAD1 | 1.65 | M-012723-01-0005 |
| DDR1 | 1.64 | D-003111-08 |
| HSP90AA1 | 1.52 | M-005186-02-0005 |
| SMAD2 | 1.44 | M-003561-01-0005 |

Table 4 provides the log 2 fold change for compounds that were observed to significantly increase the expression of ASS1, which is associated with ASS1 deficiency.

TABLE 4

ASS1 expression modulated by compounds

| ID | Compound | Fold change (Log 2) vs untreated |
|---|---|---|
| 157 | Dasatinib | 1.86 |
| 177 | CP-673451 | 1.52 |
| 119 | Echinomycin | 1.44 |
| 138 | GDF2 (BMP9) | 1.34 |
| 75 | Pacritinib (SB1518) | 1.27 |
| 207 | Epinephrine | 1.08 |
| 225 | FRAX597 | 1.06 |
| 156 | Bosutinib | 0.86 |
| 79 | TP-434 (Eravacycline) | 0.76 |
| 102 | BMP2 | 0.75 |
| 149 | SMI-4a | 0.69 |
| 170 | Amuvatinib | 0.69 |
| 199 | Crenolanib | 0.64 |
| 211 | Deoxycorticosterone | 0.6 |
| 70 | INNO-206 (aldoxorubicin) | 0.58 |
| 110 | TNF-α | 0.58 |
| 101 | T0901317 | 0.55 |

Table 5 provides the log 2 fold change for compounds that were observed to significantly increase the expression of ASL, which is associated with ASL deficiency.

TABLE 5

ASL expression modulated by compounds

| ID | Compound | Fold change (Log 2) vs untreated |
|---|---|---|
| 177 | CP-673451 | 1.81 |
| 119 | Echinomycin | 1.76 |
| 75 | Pacritinib (SB1518) | 1.45 |
| 157 | Dasatinib | 0.94 |
| 251 | Oligomycin A | 0.84 |
| 260 | Merestinib | 0.84 |

TABLE 5-continued

ASL expression modulated by compounds

| ID | Compound | Fold change (Log 2) vs untreated |
|---|---|---|
| 170 | Amuvatinib | 0.81 |
| 199 | Crenolanib | 0.76 |
| 207 | Epinephrine | 0.6 |
| 252 | BAY 87-2243 | 0.58 |
| 169 | Thalidomide | 0.56 |

Table 6 provides the log 2 fold change for compounds that were observed to significantly increase the expression of NAGS, which is associated with NAGS deficiency.

TABLE 6

NAGS expression modulated by compounds

| ID | Compound | Fold change (Log 2) vs untreated |
|---|---|---|
| 224 | AZD2858 | 2.16 |
| 41 | Enzastaurin | 2.03 |
| 156 | Bosutinib | 2.02 |
| 256 | Semaxanib | 2 |
| 70 | INNO-206 (aldoxorubicin) | 1.63 |
| 79 | TP-434 (Eravacycline) | 1.5 |
| 195 | Phenformin | 1.38 |
| 159 | Crizotinib | 1.35 |
| 149 | SMI-4a | 1.25 |
| 157 | Dasatinib | 1.21 |
| 128 | Calcitriol | 1.2 |
| 123 | Pifithrin-µ | 1.18 |
| 160 | PHA-665752 | 1.15 |
| 44 | Darapladib | 1.13 |
| 169 | Thalidomide | 1.1 |
| 66 | CO-1686 (Rociletinib) | 1.05 |
| 164 | OSU-03012 | 1.03 |
| 16 | prednisone | 1 |
| 219 | GSK2334470 | 1 |
| 155 | Afatinib | 0.98 |
| 52 | Tivozanib | 0.95 |
| 259 | SKL2001 | 0.95 |
| 162 | GDC-0879 | 0.85 |
| 62 | EVP-6124 (hydrochloride) (encenicline) | 0.75 |
| 184 | Amlodipine Besylate | 0.73 |
| 101 | T0901317 | 0.72 |
| 206 | GO6983 | 0.7 |
| 135 | Activin | 0.69 |
| 198 | WYE-125132 (WYE-132) | 0.64 |
| 253 | SIS3 | 0.64 |
| 138 | GDF2 (BMP9) | 0.63 |
| 95 | Phorbol 12, 13-dibutyrate | 0.62 |
| 122 | CD 2665 | 0.62 |
| 238 | Erlotinib | 0.62 |
| 218 | Ceritinib | 0.61 |
| 102 | BMP2 | 0.6 |
| 88 | TFP | 0.58 |
| 115 | HGF/SF | 0.56 |
| 100 | CI-4AS-1 | 0.55 |

Table 7 provides the log 2 fold change for compounds that were observed to significantly increase the expression of ARG1, which is associated with Arginase deficiency.

TABLE 7

ARG1 expression modulated by compounds

| ID | Compound | Fold change (Log 2) vs untreated |
|---|---|---|
| 50 | R788 (fostamatinib disodium hexahydrate) | 3.74 |
| 157 | Dasatinib | 3.29 |
| 177 | CP-673451 | 3.21 |
| 260 | Merestinib | 2.7 |
| 119 | Echinomycin | 2.54 |
| 170 | Amuvatinib | 2.5 |
| 207 | Epinephrine | 2.28 |
| 156 | Bosutinib | 2.27 |
| 134 | Wnt3a | 2.07 |
| 137 | Anti mullerian Hormone | 2.06 |
| 136 | Nodal | 2.05 |
| 135 | Activin | 2.01 |
| 112 | IGF-1 | 1.89 |
| 53 | 17-AAG (Tanespimycin) | 1.87 |
| 110 | TNF-a | 1.87 |
| 123 | Pifithrin-μ | 1.87 |
| 111 | PDGF | 1.85 |
| 75 | Pacritinib (SB1518) | 1.84 |
| 138 | GDF2 (BMP9) | 1.79 |
| 199 | Crenolanib | 1.7 |
| 16 | prednisone | 1.59 |
| 115 | HGF/SF | 1.51 |
| 190 | Momelotinib | 1.51 |
| 114 | EGF | 1.46 |
| 211 | Deoxycorticosterone | 1.37 |
| 113 | FGF | 1.24 |
| 169 | Thalidomide | 1.16 |
| 195 | Phenformin | 1.14 |
| 52 | Tivozanib | 1.1 |
| 252 | BAY 87-2243 | 1.09 |
| 223 | GZD824 Dimesylate | 1.06 |
| 139 | GDF 10 (BMP3b) | 0.97 |
| 233 | PND-1186 | 0.93 |
| 225 | FRAX597 | 0.82 |
| 102 | BMP2 | 0.81 |
| 251 | Oligomycin A | 0.75 |
| 19 | Rifampicin | 0.72 |
| 38 | MK-0752 | 0.71 |

Table 8 provides the log 2 fold change for compounds that were observed to significantly increase the expression of SLC25A15, which is associated with ORNT1 deficiency.

TABLE 8

SLC25A15 expression modulated by compounds

| ID | Compound | Fold change (Log 2) vs untreated |
|---|---|---|
| 157 | Dasatinib | 2.76 |
| 225 | FRAX597 | 2.51 |
| 260 | Merestinib | 2.01 |
| 50 | R788 (fostamatinib disodium hexahydrate) | 1.68 |
| 156 | Bosutinib | 1.25 |
| 84 | bms-986094 (inx-189) | 1.18 |
| 207 | Epinephrine | 1.14 |
| 138 | GDF2 (BMP9) | 1.09 |
| 119 | Echinomycin | 0.96 |
| 211 | Corticosterone | 0.96 |
| 112 | IGF-1 | 0.8 |
| 177 | CP-673451 | 0.76 |
| 223 | GZD824 Dimesylate | 0.73 |
| 230 | EW-7197 | 0.72 |
| 111 | PDGF | 0.71 |
| 134 | Wnt3 a | 0.7 |

Table 9 provides the log 2 fold change for compounds that were observed to significantly increase the expression of SLC25A13, which is associated with Citrin deficiency.

TABLE 9

SLC25A13 expression modulated by compounds

| ID | Compound | Fold change (Log 2) vs untreated |
|---|---|---|
| 88 | TFP | 0.57 |
| 53 | 17-AAG (Tanespimycin) | 0.71 |

Table 10 provides the list of compounds that were observed to significantly increase expression of multiple urea cycle-related genes.

TABLE 10

Compounds that modulate multiple genes

| ID | Compound | Pathway | Up-regulated Genes |
|---|---|---|---|
| 157 | Dasatinib | ABL | CPS1, ASS1, ASL, OTC, NAGS, ARG1, SLC25A15 |
| 119 | Echinomycin | Hypoxia activated | CPS1, ASS1, ASL, OTC, ARG1, SLC25A15 |
| 177 | CP-673451 | PDGFR | CPS1, ASS1, ASL, OTC, ARG1, SLC25A15 |
| 138 | GDF2 (BMP9) | TGF-B | ASS1, CPS1, NAGS, ARG1, SLC25A15 |
| 156 | Bosutinib | Src | ASS1, CPS1, NAGS, ARG1, SLC25A15 |
| 207 | Epinephrine | Adrenergic receptor | CPS1, ASS1, ASL, ARG1, SLC25A15 |
| 75 | Pacritinib (SB1518) | JAK-STAT | CPS1, ASS1, ASL, OTC, ARG1 |
| 170 | Amuvatinib | PDGFR | CPS1, ASS1, ASL, OTC, ARG1 |
| 225 | FRAX597 | PAK | CPS1, ASS1, OTC, ARG1, SLC25A15 |
| 169 | Thalidomide | NF-kB | NAGS, CPS1, ALS, OTC, ARG1 |
| 199 | Crenolanib | PDGFR | ASS1, ASL, OTC, ARG1 |
| 102 | BMP2 | TGF-B | ASS1, CPS1, NAGS, ARG1 |
| 211 | Deoxycorticosterone | Mineralcorticoid receptor | CPS1, ASS1, ARG1, SLC25A15 |
| 110 | TNF-α | NF-kB, MAPK, Apoptosis | CPS1, ASS1, OTC, ARG1 |
| 134 | Wnt3a | WNT | CPS1, OTC, ARG1, SLC25A15 |
| 111 | PDGF | PDGFR | CPS1, OTC, ARG1, SLC25A15 |
| 112 | IGF-1 | IGF-1R/InsR | CPS1, OTC, ARG1, SLC25A15 |
| 135 | Activin | TGF-B | NAGS, CPS1, OTC, ARG1 |

TABLE 10-continued

Compounds that modulate multiple genes

| ID | Compound | Pathway | Up-regulated Genes |
|---|---|---|---|
| 115 | HGF/SF | c-MET | NAGS, CPS1, OTC, ARG1 |
| 53 | 17-AAG (Tanespimycin) | Cell Cycle/DNA Damage; Metabolic Enzyme/Protease | CPS1, ARG1, SLC25A13 |
| 50 | R788 (fostamatinib disodium hexahydrate) | Protein Tyrosine Kinase/RTK | CPS1, ARG1, SLC25A15 |
| 223 | GZD824 Dimesylate | ABL | CPS1, ARG1, SLC25A15 |
| 252 | BAY 87-2243 | Hypoxia activated | CPS1, ASL, ARG1 |
| 16 | prednisone | GR | CPS1, NAGS, ARG1 |
| 136 | Nodal | TGF-B | CPS1, OTC, ARG1 |
| 190 | Momelotinib | JAK/STAT | CPS1, OTC, ARG1 |
| 113 | FGF | FGFR | CPS1, OTC, ARG1 |
| 114 | EGF | EGFR | CPS1, OTC, ARG1 |
| 137 | Anti mullerian hormone | TGF-B | CPS1, OTC, ARG1 |
| 70 | INNO-206 (aldoxorubicin) | Cell Cycle/DNA Damage | NAGS, ASS1, OTC |
| 123 | Pifithrin-µ | p53 | OTC, NAGS, ARG1 |

As shown above, Dasatinib was observed to significantly up-regulate the expression of seven urea cycle genes with log 2 fold changes ≥1. Echinomycin and CP-673451 were observed to significantly up-regulate the expression of six urea cycle genes. GDF2 (BMP9), Bosutinib, Epinephrine, Pacritinib (SB1518), Amuvatinib, FRAX597, and Thalidomide were observed to significantly up-regulate the expression of five urea cycle genes. Crenolanib, BMP2, Deoxycorticosterone, TNF-α, Wnt3a, PDGF, IGF-1, Activin, and HGF/SF were observed to significantly up-regulate the expression of four urea cycle genes. 17-AAG (Tanespimycin), R788 (fostamatinib disodium hexahydrate), GZD824 Dimesylate, BAY 87-2243, prednisone, Nodal, Momelotinib, FGF, EGF, Anti mullerian hormone, INNO-206 (aldoxorubicin), and Pifithrin-µ, were observed to significantly up-regulate the expression of three urea cycle genes.

Dasatinib is a novel, potent and multi-targeted inhibitor that targets Abl, Src and c-Kit. This suggest that inhibiting signaling molecules, particularly Abl, Src or c-Kit, in the Abl-, Src- or c-Kit-mediated signaling pathways may potentially up-regulate enzymes of the urea cycle.

Mubritinib (TAK-165) is a potent inhibitor of HER2/ErbB2 with IC50 of 6 nM in BT-474 cells.

XL228 is designed to inhibit the insulin-like growth factor type-1 receptor (IGF1R), Src and Abl tyrosine kinases—targets that play crucial roles in cancer cell proliferation, survival and metastasis.

Three identified compounds, Foretinib/XL880, Regorafenib, are known modulators of the Vascular endothelial growth factor receptor (VEGFR) family mediated signaling pathway. This suggest that modulating signaling molecules, particularly VEGFRs, in the VEGFR-mediated signaling pathway may potentially up-regulate enzymes of the urea cycle.

Six identified compounds, CP-673451, Amuvatinib, Crenolanib, Sunitinib, Amuvatinib, and PDGF, are known modulators of the Platelet-derived growth factor receptor (PDGFR)-mediated signaling pathway. This suggest that modulating signaling molecules, particularly PDGFRs, in the PDGFR-mediated signaling pathway may potentially up-regulate enzymes of the urea cycle.

Three identified compounds, Pazopanib, Linifanib, Regorafenib, are known modulators of the Platelet-derived growth factor receptor (PDGFR) and Vascular endothelial growth factor receptor (VEGFR) family mediated signaling pathway. This suggest that modulating signaling molecules, particularly PDGFRs, VEGFRs, in the PDGFR and VEGFR-mediated signaling pathway may potentially up-regulate enzymes of the urea cycle.

Five identified compounds, PF-04929113 (SNX-5422), 17-AAG, BIIB021, HSP-990, Retaspimycin Hydrochloride, are known modulators of the Heat shock protein 90 (HSP90) mediated signaling pathway. This suggest that modulating signaling molecules, particularly HSP90 may potentially up-regulate enzymes of the urea cycle.

Five identified compounds, GDF2 (BMP9), BMP2, Activin, Nodal and Anti mullerian hormone, Dorsomorphin are known modulators of the transforming growth factor-beta (TGF-B) signaling pathway. This suggest that modulating signaling molecules, particularly TGF-B and/or Bone morphogenetic protein receptor type-1A (BMPR1A), in the TGF-B signaling pathway may potentially up-regulate enzymes of the urea cycle.

Five identified compounds, Momelotinib, Baricitinib, GLPG0634, AZD1480, LY2784544, TAK-901, Tofacitinib citrate, are known modulators of the JAK mediated signaling pathway. This suggest that modulating signaling molecules, particularly JAK/STAT may potentially up-regulate enzymes of the urea cycle.

Three identified compounds, CCCP, BX795, MRT67307 are known modulators of the TBK1/Ikke mediated signaling pathway. This suggest that modulating signaling molecules, particularly through TBK1 pathway may potentially upregulate urea cycle enzymes.

Seven identified compounds, AS602801 (Bentamapimod), PF-00562271, BIRB 796, Pamapimod, R1487 Hydrochloride, Bardoxolone, PH-797804, are known modulators of the MAPK mediated signaling pathway. This suggest that modulating signaling molecules, particularly MAPK may potentially up-regulate enzymes of the urea cycle.

Mubritinib (TAK-165) is a potent inhibitor of HER2/ErbB2 with IC50 of 6 nM in BT-474 cells.

XL228 is designed to inhibit the insulin-like growth factor type-1 receptor (IGF1R), Src and Abl tyrosine kinases—targets that play crucial roles in cancer cell proliferation, survival and metastasis Sunitinib inhibits cellular signaling by targeting multiple RTKs. These include all platelet-derived growth factor receptors (PDGF-R) and vascular endothelial growth factor receptors (VEGF-R). Sunitinib also inhibits KIT (CD117), the RTK that drives the majority of GISTs. In addition, sunitinib inhibits other RTKs including RET, CSF-1R, and flt3

Lifirafenib (BGB-283) potently inhibits RAF family kinases and EGFR activities in biochemical assays with IC50 values of 23, 29 and 495 nM for the recombinant BRAFV600E kinase domain, EGFR and EGFR T790M/L858R mutant.

Foretinib (GSK1363089) is an ATP-competitive inhibitor of HGFR and VEGFR, mostly for Met and KDR with IC50 of 0.4 nM and 0.9 nM in cell-free assays. Less potent against Ron, Flt-1/3/4, Kit, PDGFRα/β and Tie-2, and little activity to FGFR1 and EGFR.

BIIB021 is an orally available, fully synthetic small-molecule inhibitor of HSP90 with $K_i$ and EC50 of 1.7 nM and 38 nM, respectively NVP-HSP990 (HSP990) is a novel, potent and selective HSP90 inhibitor for HSP90α/β with IC50 of 0.6 nM/0.8 nM.

IPI-504 is a novel, water-soluble, potent inhibitor of heat-shock protein 90 (Hsp90

Baricitinib is a selective and reversible Janus kinase 1 (JAK1) and 2 (JAK2) inhibitor Doramapimod (BIRB 796) is a pan-p38 MAPK inhibitor with IC50 of 38 nM, 65 nM, 200 nM and 520 nM for p38α/β/γ/δ in cell-free assays, and binds p38α with $K_d$ of 0.1 nM in THP-1 cells, 330-fold greater selectivity versus JNK2.

Pamapimod is a potent inhibitor of p38a MAP kinase ($IC_{50}$=14 nM).[1] It displays over 30-fold selectivity for p38α over p38β, has no activity against p38δ or p38γ, and has limited activity against a panel of 350 other kinases Farnesyltransferase inhibitor BMS-214662 inhibits the enzyme farnesyltransferase and the post-translational farnesylation of number of proteins involved in signal transduction, which may result in the inhibition of Ras function and apoptosis in susceptible tumor cells.

The results also suggest that expression of urea cycle enzymes may be associated with other signaling pathways, such as the NF-kB signaling pathway, hypoxia activated signaling pathway, Src signaling pathway, c-MET signaling pathway, cell cycle/DNA damage pathway, Adrenergic receptor-mediated pathway, PAK signaling pathway, MAPK signaling pathway, farnesyl transferase, EGFR, FGFR and apoptosis. Modulating one of these pathways may also lead to up-regulation of the urea cycle enzymes.

Example 5. Determining Genomic Position and Composition of Signaling Centers

A multilayered approach is used herein to identify locations or the "footprint" of signaling centers. The linear proximity of genes and enhancers is not always instructive to determine the 3D conformation of the signaling centers.

ChIP-seq was used to determine the genomic position and composition of signaling centers. Antibodies specific to 67 targets, including transcription factors, signaling proteins, and chromatin modifications, were selected for validation in HepG2 cells using ChIP-seq. These validated antibodies were used in ChIP-seq for hepatocytes to create a two-dimensional (2D) map. These antibody targets are shown in Table 11.

TABLE 11

ChIP-seq targets for primary human hepatocytes

| Chromatin | Transcription factors | | Signaling proteins | |
|---|---|---|---|---|
| H3K4me3 | HNF1A | RNA Pol II | STAT1-JAK/STAT | NR3C1 (glucocorticoid receptor) - nuclear receptor signaling |
| H3K27ac | FOXA1 | ONECUT2 | STAT3-JAK/STAT | AR (androgen receptor) - nuclear receptor signaling |
| H3K4me1 | HNF4A | PROX1 | TP53-p53, mTOR, AMPK | ESR1 (estrogen receptor) - nuclear receptor signaling |
| H3K27me3 | NROB2 | YY1 | TEAD 1/2-Hippo | NR1H3 (liver X receptor alpha) - nuclear receptor signaling |
| p300 | FOXA2 | CTCF | NF-κB (p65)-NF-κB | NR1H4 (farnesoid X receptor) - nuclear receptor signaling |
| BRD4 | CUX2 | ONECUT1 | CREB1-MAPK | AHR (aryl hydrocarbon receptor) - aryl hydrocarbon signaling |
| SMC1 | HHEX | MYC | CREB2-MAPK | NR1I2 (pregnane X receptor) - nuclear receptor signaling |
| | ZGPAT | | JUN-TLR, MAPK | HIF1a (hypoxia inducible factor) - hypoxia activated signaling |
| | NR1I3 | | FOS-TLR, MAPK | TCF7L2 (TCF4)-WNT |
| | ATF5 | | ELK1-MAPK | CTNNB1-WNT |
| | | | SMAD2/3-TGFβ, | RBPJ - NOTCH |
| | | | SMAD4 - TGFβ, | SREBP1 - cholesterol biosynthesis |
| | | | SMAD1/5/8 - TGFβ, | SREBP2 - cholesterol biosynthesis |
| | | | ETV4 - RK MAPK | RXR (RA pathway) - nuclear receptor signaling |
| | | | RARA - nuclear receptor signaling | NR3C2 (Mineralocorticoid receptor) - nuclear receptor signaling |
| | | | NR1I1 (Vitamin D receptor) - nuclear receptor signaling | STAT5 - JAK/STAT |
| | | | NR5A2 (liver receptor homolog 1) - nuclear receptor signaling | PPARG - nuclear receptor signaling |
| | | | YAP1 - Hippo signaling | PPARA - nuclear receptor signaling |
| | | | TAZ - Hippo signaling | mTOR - mTOR signaling |

TABLE 11-continued

ChIP-seq targets for primary human hepatocytes

| Chromatin | Transcription factors | Signaling proteins |
|---|---|---|
| | MLXIPL - carbohydrate response signaling<br>GLI1 - Hedgehog signaling<br>WWTR1 - Hippo signaling | GLI3 - Hedgehog signaling<br><br>ATR - DNA damage response signaling |

In the signaling proteins column, the associated canonical pathway is included after the "-".

Table 12 shows the chromatin marks, and chromatin-associated proteins, transcription factors, and specific signaling proteins/or factors associated with the insulated neighborhood of each urea cycle-related gene in primary human hepatocytes.

TABLE 12

ChIP-seq results

| Gene | Chromatin | Transcription factors | Specific signaling proteins/or factors |
|---|---|---|---|
| CPS1 | H3K27ac, BRD4, p300, SMC1 | FOXA2, HNF4A, ONECUT1, ONECUT2, YY1 | TCF7L2, ESRA, FOS, NR3C1, JUN, NR5A2, RBPJK, RXR, STAT3, NR1I1, NF-kB, SMAD2/3, SMAD4, STAT1, TEAD1, TP53 |
| OTC | H3K27ac, BRD4 | FOXA2, HNF4A, ONECUT1, ONECUT2, YY1, HNF1A | TCF7L2, HIF1a, ESRA, NR3C1, JUN, RXR, STAT3, NF-kB, SMAD2/3, SMAD4, TEAD1 |
| ASS1 | H3K27ac, BRD4, p300, SMC1 | FOXA2, HNF4A, ONECUT1, MYC, YY1 | CREB1, NR1H4, HIF1a, ESRA, JUN, RXR, STAT3, NR1I1, NF-kB, NR3C1, SMAD2/3, SMAD4, TEAD1 |
| ASL | H3K27ac, BRD4, p300 | HNF3, HNF4A, ONECUT1, HNF1A, MYC | TCF7L2, CREB1, NR1H4, HIF1a, ESRA, FOS, JUN, RBPJK, RXR, STAT3, NR1I1, NF-kB, NR3C1, SMAD2/3, SMAD4, STAT1, TEAD1, TP53 |
| NAGS | H3K27ac, BRD4, p300 | FOXA2, HNF4A, ONECUT1, ONECUT2, YY1, HNF1A | TCF7L2, HIF1a, AHR, ESRA, JUN, RXR, STAT3, NR1I1, NF-kB, NR3C1, SMAD2/3, SMAD4, TEAD1, TP53 |
| ARG1 | H3K27ac, BRD4, p300 | FOXA2, HNF4A, ONECUT1, ONECUT2, YY1, HNF1A, MYC | HIF1a, ESRA, NR3C1, JUN, RXR, STAT3, NR1I1, SMAD2/3, STAT1, TEAD1 |
| SLC25A15 | H3K27ac, BRD4 | FOXA2, HNF4A, ONECUT1, ONECUT2, YY1 | ESRA, Jun, RXR, NR1I1, NF-kB, NR3C1, SMAD2/3, TP53 |
| SLC25A13 | H3K27ac, BRD4, p300, SMC1 | FOXA2, HNF4A, ONECUT1, ATF5, ONECUT2, YY1, HNF1A, MYC | TCF7L2, HIF1a, ESRA, NR3C1, JUN, RXR, STAT3, NR1I1, NF-kB, SMAD2/3, STAT1, TEAD1, TP53 |

Example 6. RNA-Seq Result Validation

Compounds identified from initial RNA-seq analysis are subjected to validation with qRT-PCR. qRT-PCR is performed on samples of primary human hepatocytes from a second donor stimulated with identified compounds. Compounds are tested at different concentrations and with different cell lots. Fold change in gene expression observed via qRT-PCR is compared to that from RNA-seq analysis. Compounds that cause robust increase in the expression of at least one urea cycle enzyme are selected for further characterization.

Example 7. Disruption of Pathway of Interest

Canonical pathways that showed connection with changes in the expression of urea cycle enzymes are perturbed with additional compounds to confirm the involvement of the pathway in the regulation of urea cycle enzymes. In one embodiment, primary human hepatocytes are treated with additional compounds that target different components in the PDGFR-mediated signaling pathway. In another embodiment, primary human hepatocytes are treated with additional compounds that target different components in the TGF-B signaling pathway. Expression of selected urea cycle enzymes in stimulated hepatocytes is analyzed with RNA-seq as described in Example 1. Hepatic stellate cells are also treated with the same compounds and the effect of the perturbed pathway on gene expression is compared. Changes in binding patterns of the signaling proteins are examined using ChIP. Results are utilized to illustrate gene signaling networks controlling expression of selected urea cycle enzymes and identify additional compounds that modulate selected urea cycle enzymes in the desired direction.

Example 8. Compound Testing in Other Liver Cell Lines

In one embodiment, candidate compounds are evaluated in a hepatic stellate cells to confirm their efficacy. Changes in target gene expression in stellate cells are analyzed with qRT-PCR. Results are compared with that from the primary hepatocytes. Compounds that show consistent induction of at least one urea cycle enzyme are selected for further analysis.

Example 9. Compound Testing in Patient Cells

Candidate compounds are evaluated in patient derived induced pluripotent stem (iPS)-hepatoblast cells to confirm their efficacy. Selected patients have deficiency in at least one of the urea cycle enzymes. Changes in target gene expression in iPS-hepatoblast cells are analyzed with qRT-PCR. Results are used to confirm if the pathway is similarly functional in patient cells and if the compounds have the same impact.

Example 10. Compound Testing in a Mouse Model

Candidate compounds are evaluated in a mouse model of a urea cycle disorder (e.g., CPS1 deficiency, OTC deficiency, ASS1 Deficiency, ASL deficiency, NAGS deficiency, Arginase deficiency, ORNT1 deficiency, or Citrin deficiency) for in vivo activity and safety.

Example 11. Identification of Additional Compounds that Modulate Expression of Urea Cycle Enzymes Additional small molecules that modulate urea cycle enzymes were tested in primary human hepatocytes as described in Example 2. Molecules were tested in triplicate, the results are shown as the relative mRNA levels of each target gene after treatment compared to an untreated control (DMSO), ±standard deviation. In additional, previously tested molecules were tested again at varying concentrations.

The additional compounds used to perturb the signaling centers of hepatocytes include at least one compound listed in Table 13. In the table, compounds are listed with their ID, target, pathway, and pharmaceutical action. Most compounds chosen as perturbation signals are known in the art to modulate at least one canonical cellular pathway.

TABLE 13

Compounds used in RNA-seq

| ID | Compound Name | CAS Number | Target |
|---|---|---|---|
| 279 | CZ415 | 1429639-50-8 | mTOR |
| 280 | AZD-8055 | 1009298-09-2 | mTOR |
| 308 | OSI-027 | 936890-98-1 | mTOR |
| 316 | XL228 | 898280-07-4 | BCR-Abl, IGF-1R |
| 320 | BIIB021 | 848695-25-0 | HSP |
| 323 | PF-04929113 (SNX-5422) | 1173111-67-5 | HSP90 |
| 326 | BX795 | 702675-74-9 | PDK1, TBK1 |
| 327 | CCCP | 555-60-2 | STING |
| 551 | Sunitinib | 557795-19-4 | PDGFR, c-Kit, VEGFR |
| 587 | Linifanib (ABT-869) | 796967-16-3 | PDGFR, VEGFR |
| 593 | Luminespib (AUY-922, NVP-AUY922) | 747412-49-3 | HSP90 |
| 594 | Iniparib (BSI-201) | 160003-66-7 | PARP1 |
| 600 | Foretinib (GSK1363089) | 849217-64-7 | HGFR, VEGFR |
| 616 | AZD8055 | 1009298-09-2 | mTOR |
| 617 | BAY 87-2243 | 1227158-85-1 | HIF1a |
| 619 | AZD8330 | 869357-68-6 | MEK 1/2 |
| 626 | Mubritinib (TAK 165) | 366017-09-6 | HER2 |
| 630 | PF-00562271 | 939791-38-5 | FAK |

TABLE 13-continued

Compounds used in RNA-seq

| ID | Compound Name | CAS Number | Target |
|---|---|---|---|
| 650 | Voxtalisib (XL765, SAR245409) | 934493-76-2 | mTOR, PI3K |
| 654 | Lifirafenib (BGB-283) | 1446090-79-4 | Raf, EGFR |
| 684 | R1487 Hydrochloride | 449808-64-4 | p38α |
| 685 | Pamapimod | 449811-01-2 | MAP kinases |
| 725 | PF-3814735 | 942487-16-3 | Aurora A/B |
| 745 | RO4987655 (Synonyms: CH4987655) | 874101-00-5 | MEK |
| 746 | PD173074 | 219580-11-7 | FGFR1 |
| 747 | warfarin | 81-81-2 | epoxide reductase |
| 919 | AS602801 (Bentamapimod) | 848344-36-5 | JNK |
| 920 | SB1317/TG02 | 937270-47-8 | CDK2, JAK2, FLT3 |
| 924 | AT9283 | 896466-04-9 | Aurora A/B, JAK2, JAK3, c-ABL |
| 925 | Retaspimycin Hydrochloride | 857402-63-2 | HSP90 |

Analysis of RNA-seq data revealed a number of compounds that caused changes in the expression of CPS1, OTC, ASS1, ASL, NAGS, SLC25A13 (which encode citrin), and SLC25A15 (which encodes ORNT1). RNA-seq results for compounds that modulated at least one target gene are shown in Tables 14-25.

Table 14 provides the relative fold change for compounds that were observed to increase the expression of OTC, which is associated with OTC deficiency.

TABLE 14

OTC expression modulated by compounds

| Compound | Concentration, μM | Relative OTC level vs Untreated (±Standard Deviation) |
|---|---|---|
| Dasatinib | 3 uM | 1.50 ± 0.50 |
| Dasatinib | 10 uM | 1.51 ± 0.16 |
| CP-673451 | 10 uM | 3.36 ± 1.73 |
| Crenolanib | 3 uM | 2.07 ± 0.86 |
| Crenolanib | 10 uM | 4.58 ± 0.86 |
| BAY 87-2243 | 0.3 uM | 3.33 ± 0.60 |
| BAY 87-2243 | 1 uM | 5.61 ± 3.28 |
| BAY 87-2243 | 3 uM | 7.03 ± 3.84 |
| BAY 87-2243 | 10 uM | 6.18 ± 1.58 |
| Mubritinib | 0.3 uM | 1.79 ± 0.81 |
| Mubritinib | 1 uM | 2.83 ± 0.48 |
| Mubritinib | 3 uM | 4.05 ± 0.10 |
| Mubritinib | 10 uM | 3.86 ± 0.55 |
| PF-00562271 | 3 uM | 3.27 ± 0.59 |
| PF-00562271 | 10 uM | 7.05 ± 1.14 |

Figure 6:
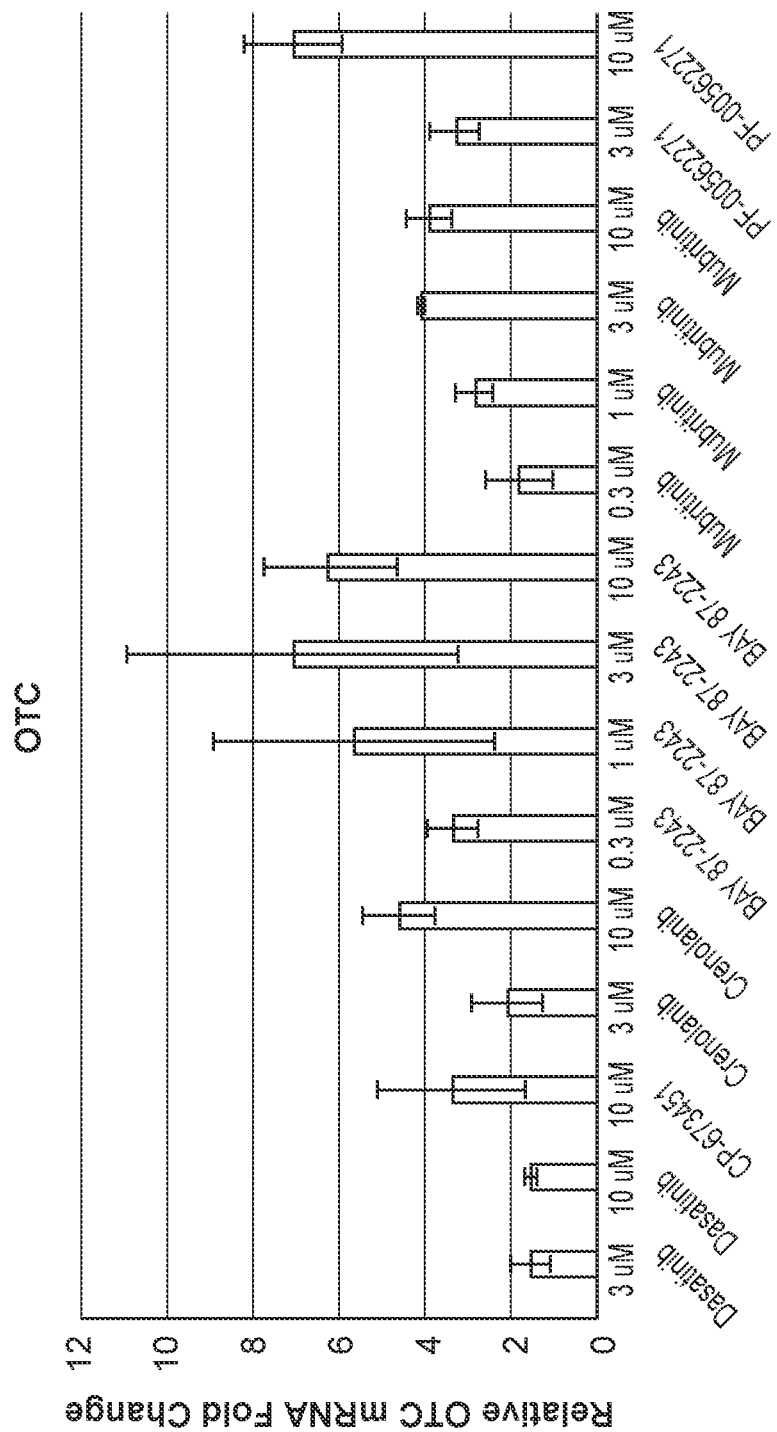
FIG. 6 shows OTC gene expression after treatment with the indicated compounds.

The OTC results are also shown in FIG. 6. Treatment with BAY 87-2243 or PF-00562271 resulted in the greatest increase in OTC gene expression, while treatment with Crenolanib, CP-673451, and Mubritinib still resulted in a significant increase in OTC gene expression.

Tables 15 and 16 provides the relative fold change for compounds that were observed to increase the expression of ASS1, which is associated with ASS1 deficiency.

TABLE 15

ASS1 expression modulated by compounds

| Compound | Concentration, μM | Relative ASS1 level vs Untreated (±Standard Deviation) |
|---|---|---|
| Echinomycin | 0.3 μM | 1.57 ± 0.09 |
| Echinomycin | 1 μM | 1.70 ± 0.04 |
| Echinomycin | 3 μM | 1.64 ± 0.04 |
| Echinomycin | 10 μM | 1.84 ± 0.07 |
| Dasatinib | 10 μM | 1.68 ± 0.04 |
| CZ415 | 10 μM | 1.65 ± 0.11 |
| AZD-8055 | 10 μM | 1.66 ± 0.11 |
| OSI-027 | 1 μM | 1.55 ± 0.16 |
| OSI-027 | 3 μM | 1.45 ± 0.10 |
| OSI-027 | 10 μM | 2.05 ± 0.00 |
| XL228 | 1 μM | 1.83 ± 0.02 |
| XL228 | 3 μM | 1.45 ± 0.10 |
| XL228 | 10 μM | 2.05 ± 0.00 |
| BIIB021 | 1 μM | 1.39 ± 0.06 |
| BIIB021 | 10 μM | 1.41 ± 0.28 |
| 17-AAG | 0.3 μM | 1.37 ± 0.11 |
| 17-AAG | 1 μM | 1.46 ± 0.07 |
| Sunitinib | 3 μM | 2.25 ± 0.45 |
| Sunitinib | 10 μM | 2.70 ± 0.37 |
| Foretinib | 10 μM | 1.82 ± 0.11 |
| AZD8055 | 10 μM | 1.44 ± 0.27 |
| BAY 87-2243 | 0.3 μM | 2.79 ± 0.22 |
| BAY 87-2243 | 1 μM | 3.10 ± 0.47 |
| BAY 87-2243 | 3 μM | 2.38 ± 0.01 |
| BAY 87-2243 | 10 μM | 2.99 ± 0.36 |
| Mubritinib | 1 μM | 2.56 ± 0.11 |
| Mubritinib | 3 μM | 2.23 ± 0.53 |
| Mubritinib | 10 μM | 2.52 ± 0.15 |
| Voxtalisib | 10 μM | 1.43 ± 0.13 |
| Lifirafenib | 10 μM | 1.55 ± 0.28 |
| Pamapimod | 10 μM | 1.54 ± 0.86 |
| PF-3814735 | 10 μM | 1.56 ± 0.17 |
| Bentamapimod | 10 μM | 1.90 ± 0.22 |
| SB1317/TG02 | 1 μM | 1.34 ± 0.12 |
| SB1317/TG02 | 3 μM | 1.90 ± 0.19 |
| SB1317/TG02 | 10 μM | 1.92 ± 0.18 |
| AT9283 | 3 μM | 1.40 ± 0.43 |
| AT9283 | 10 μM | 2.48 ± 0.79 |
| Retaspimycin Hydrochloride | 10 | 1.38 ± 0.13 |

TABLE 15

ASS1 expression modulated by compounds

| Compound | Concentration, μM | Relative ASS1 level vs Untreated (±Standard Deviation) |
|---|---|---|
| Dasatinib | 10 uM | 1.83 ± 0.51 |
| CP-673451 | 10 uM | 2.13 ± 0.68 |
| Crenolanib | 10 uM | 2.35 ± 0.63 |
| BAY 87-2243 | 0.3 uM | 2.11 ± 0.33 |
| BAY 87-2243 | 01 uM | 2.61 ± 0.57 |
| BAY 87-2243 | 03 uM | 2.87 ± 1.80 |
| BAY 87-2243 | 10 uM | 2.86 ± 1.48 |
| Mubritinib | 0.3 uM | 1.66 ± 0.98 |
| Mubritinib | 01 uM | 1.87 ± 0.24 |
| Mubritinib | 0.3 uM | 2.14 ± 0.39 |
| Mubritinib | 10 uM | 2.77 ± 0.69 |
| PF-00562271 | 10 uM | 2.30 ± 0.41 |

Figure 7:
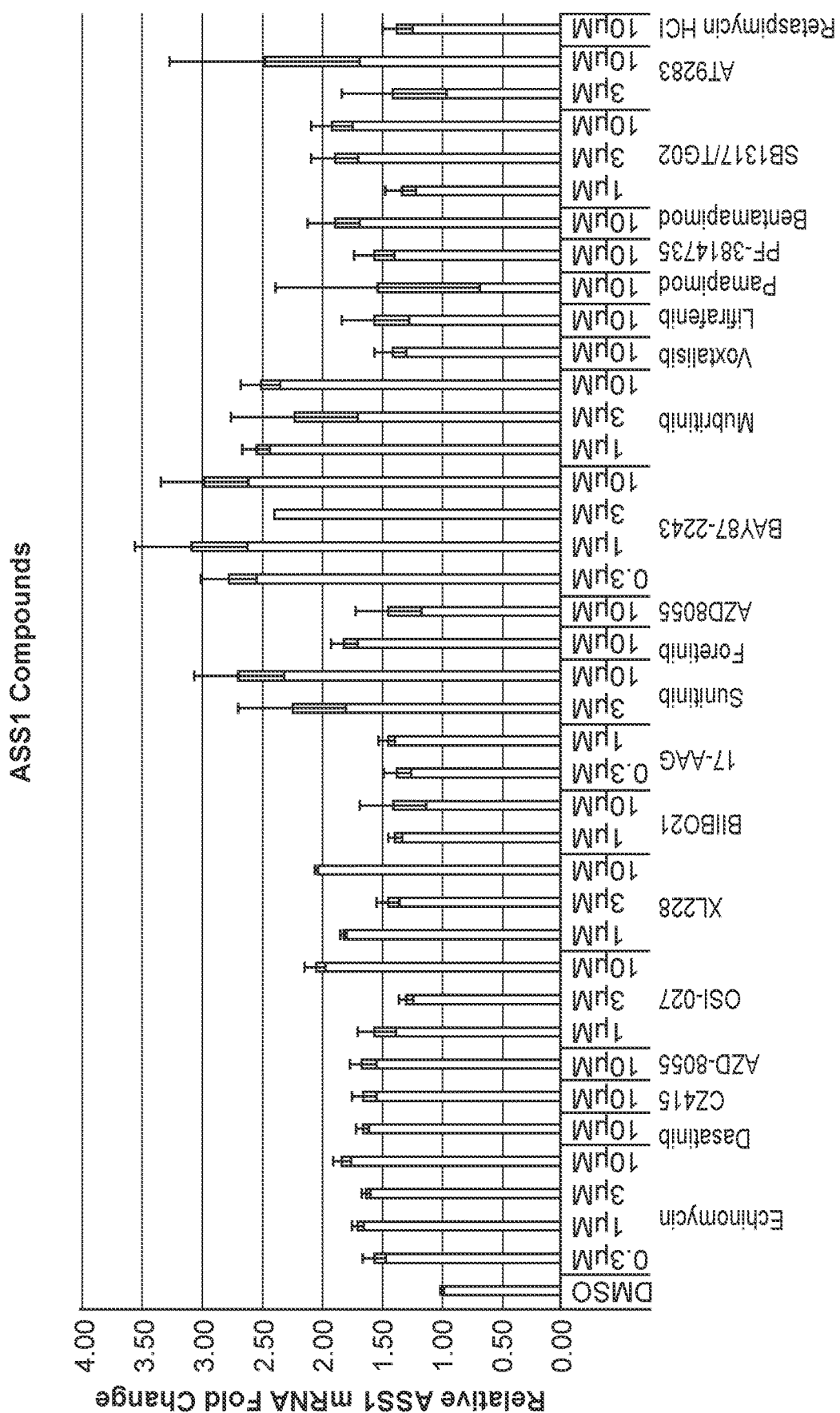
FIG. 7 shows ASS1 gene expression after treatment with the indicated compounds.
Figure 8:
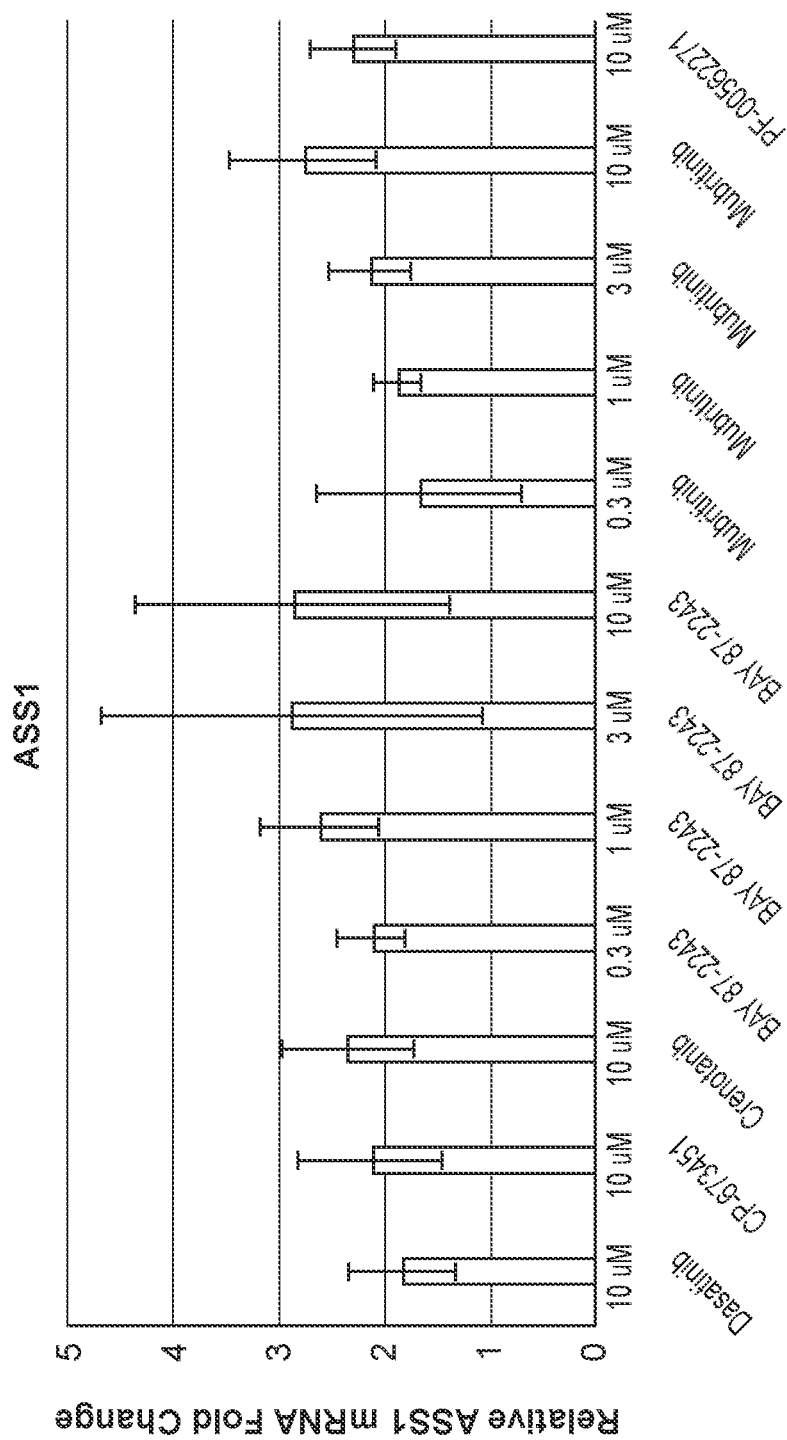
FIG. 8 shows ASS1 gene expression after treatment with the indicated compounds.

The ASS1 results for Table 15 are also shown in FIG. 7 and for Table 16 in FIG. 8. Treatment with BAY 87-2243, AT9283, Sunitinib, or Mubritinib resulted in the greatest increase in ASS1 gene expression.

Tables 17 and 18 provides the relative fold change for compounds that were observed to increase the expression of ARG1, which is associated with ARG1 deficiency.

TABLE 17

ARG1 expression modulated by compounds

| Compound | Concentration, μM | Relative ARGI level vs Untreated (±Standard Deviation) |
|---|---|---|
| Echinomycin | 10 μM | 1.34 ± 0.16 |
| Dasatinib | 10 μM | 1.63 ± 0.59 |
| Amuvatinib | 10 μM | 1.71 ± 0.19 |
| CZ415 | 3 μM | 1.35 ± 0.12 |
| AZD-8055 | 0.3 μM | 1.44 ± 0.09 |
| AZD-8055 | 1 μM | 1.43 ± 0.25 |
| AZD-8055 | 3 μM | 1.36 ± 0.07 |
| XL228 | 0.3 μM | 1.47 ± 0.11 |
| XL228 | 1 μM | 2.05 ± 0.11 |
| XL228 | 3 μM | 2.15 ± 0.04 |
| BIIB021 | 3 μM | 1.38 ± 0.33 |
| BX795 | 3 μM | 1.33 ± 0.43 |
| BX795 | 10 μM | 1.34 ± 0.41 |
| Sunitinib | 10 μM | 1.36 ± 0.01 |
| Luminespib | 10 μM | 1.34 ± 0.07 |
| Iniparib | 3 μM | 1.32 ± 0.15 |
| Foretinib | 3 μM | 1.40 ± 0.00 |
| Foretinib | 10 μM | 1.61 ± 0.12 |
| AZD8055 | 1 μM | 1.34 ± 0.24 |
| AZD8055 | 3 μM | 1.42 ± 0.03 |
| AZD8055 | 10 μM | 1.35 ± 0.08 |
| BAY 87-2243 | 0.3 μM | 1.36 ± 0.43 |
| BAY 87-2243 | 1 μM | 1.98 ± 0.29 |
| BAY 87-2243 | 3 μM | 2.06 ± 0.19 |
| BAY 87-2243 | 10 μM | 2.03 ± 0.28 |
| Mubritinib | 3 μM | 1.93 ± 0.05 |
| Mubritinib | 10 μM | 1.86 ± 0.04 |
| PF-00562271 | 10 μM | 1.32 ± 0.33 |
| Voxtalisib | 3 μM | 1.34 ± 0.16 |
| Voxtalisib | 10 μM | 1.48 ± 0.18 |
| PF-3814735 | 1 μM | 1.44 ± 0.02 |
| PF-3814735 | 3 μM | 2.45 ± 0.43 |
| wafarin | 10 μM | 1.33 ± 0.62 |
| AT9283 | 10 μM | 1.70 ± 0.16 |
| Retaspimycin Hydrochloride | 3 μM | 1.31 ± 0.12 |

TABLE 18

ARG1 expression modulated by compounds

| Compound | Concentration, μM | Relative ARGI level vs Untreated (±Standard Deviation) |
|---|---|---|
| CP-6734M | 10 uM | 2.45 ± 1.06 |
| Crenolanib | 10 uM | 2.60 ± 0.76 |
| BAY 87-2243 | 10 uM | 5.64 ± 3.44 |
| PF-00562271 | 10 uM | 2.53 ± 0.36 |

Figure 9:
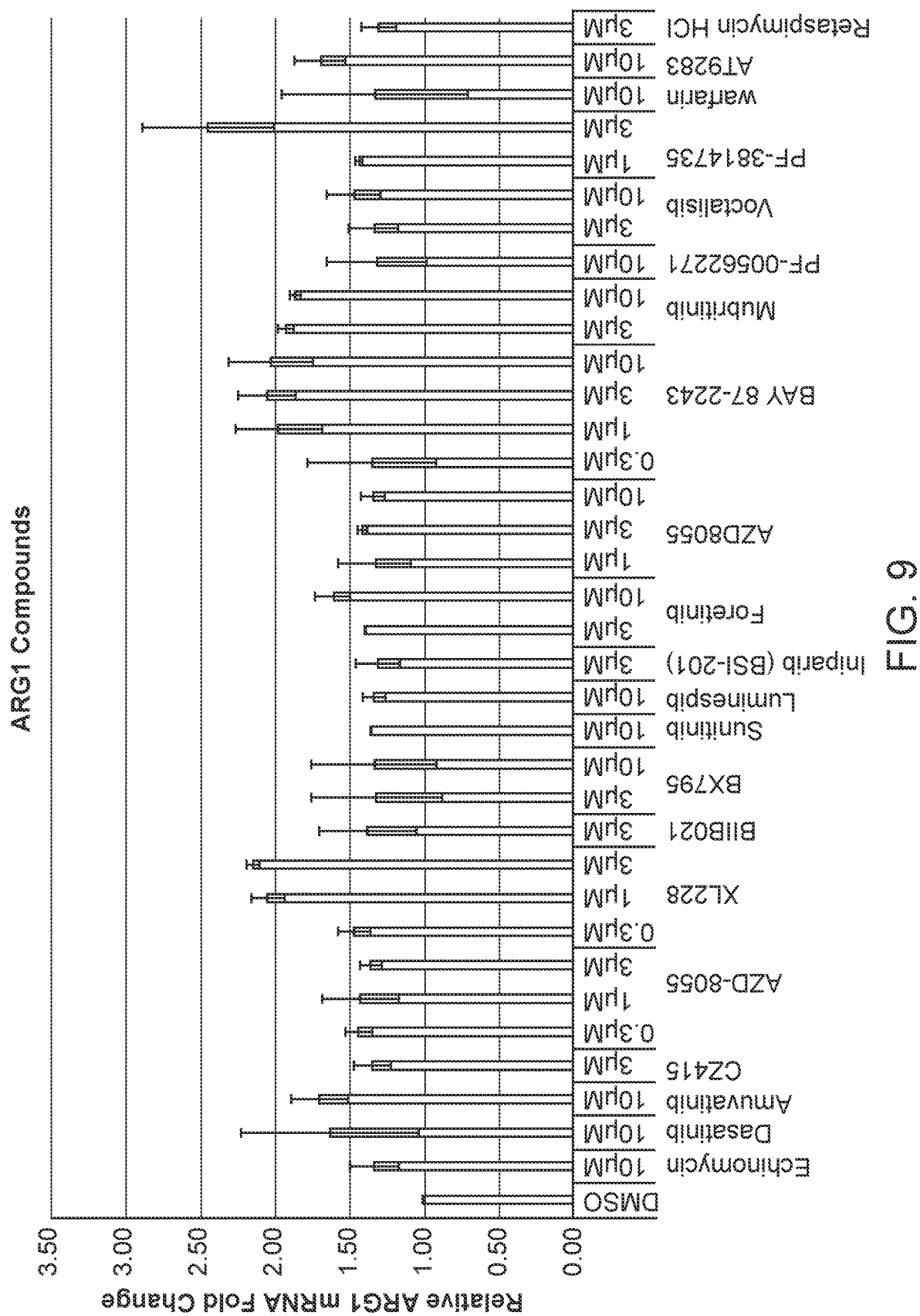
FIG. 9 shows ARG1 gene expression after treatment with the indicated compounds.
Figure 10:
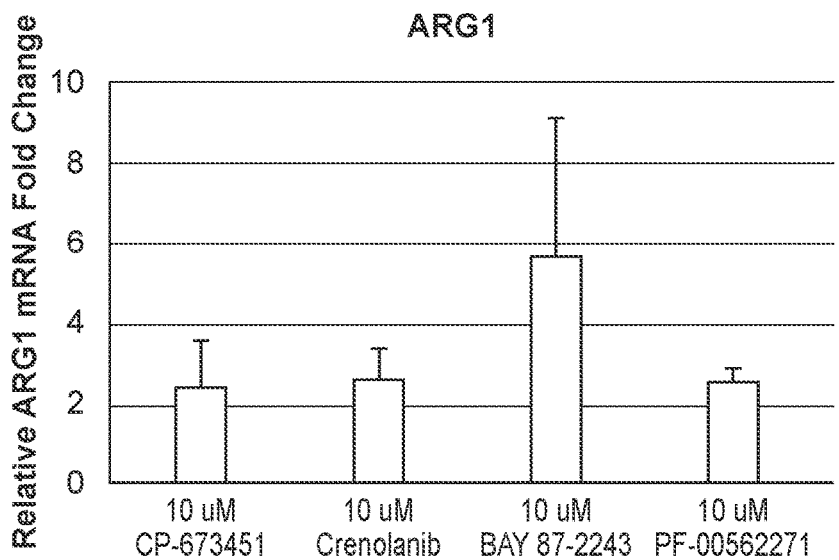
FIG. 10 shows ARG1 gene expression after treatment with the indicated compounds.

The ARG1 results for Table 17 are also shown in FIG. 9 and for Table 18 in FIG. 10. Treatment with CP-673451, Crenolanib, BAY 87-2243, PF-00562271, XL228, Mubritinib, or PF-3814735 resulted in the greatest increase in ARG1 gene expression.

Tables 19 and 20 provides the relative fold change for compounds that were observed to increase the expression of CPS1, which is associated with CPS1 deficiency.

TABLE 19

CPS1 expression modulated by compounds

| Compound | Concentration, μM | Relative CPS1 level vs Untreated (±Standard Deviation) |
|---|---|---|
| Dasatinib | 10 μM | 2.89 ± 0.41 |
| Amuvatinib | 10 μM | 2.07 ± 0.42 |

TABLE 19-continued

CPS1 expression modulated by compounds

| Compound | Concentration, μM | Relative CPS1 level vs Untreated (±Standard Deviation) |
|---|---|---|
| Crenolanib | 3 μM | 1.56 ± 0.12 |
| Crenolanib | 10 μM | 1.34 ± 0.11 |
| CZ415 | 1 μM | 1.32 ± 0.04 |
| AZD-8055 | 1 μM | 1.42 ± 0.24 |
| PF-04929113 | 3 μM | 1.38 ± 0.13 |
| BX795 | 3 μM | 1.75 ± 1.03 |
| Iniparib | 3 μM | 1.44 ± 0.01 |
| Foretinib | 3 μM | 1.37 ± 0.30 |
| Foretinib | 10 μM | 1.75 ± 0.30 |
| AZD8055 | 0.3 μM | 1.38 ± 0.27 |
| AZD8055 | 1 μM | 1.38 ± 0.67 |
| AZD8055 | 3 μM | 1.60 ± 0.07 |
| BAY 87-2243 | 3 μM | 1.41 ± 0.06 |
| AZD8330 | 0.3 μM | 1.33 ± 0.03 |
| AZD8330 | 3 μM | 1.60 ± 0.24 |
| Mubritinib | 0.3 μM | 1.41 ± 0.46 |
| Mubritinib | 3 μM | 1.34 ± 0.04 |
| PF-3814735 | 3 μM | 2.25 ± 0.74 |
| RO4987655 | 1 μM | 1.46 ± 0.27 |
| RO4987655 | 10 μM | 1.33 ± 0.21 |
| PD173074 | 3 μM | 1.35 ± 0.03 |
| AT9283 | 3 μM | 2.35 ± 0.15 |
| AT9283 | 10 μM | 1.53 ± 0.33 |

TABLE 20

CPS1 expression modulated by compounds

| Compound | Concentration, μM | Relative CPS1 level vs Untreated (±Standard Deviation) |
|---|---|---|
| Dasatinib | 1 uM | 5.24 ± 0.68 |
| Dasatinib | 3 uM | 10.61 ± 4.31 |
| Dasatinib | 10 uM | 13.12 ± 5.07 |
| CP-673451 | 10 uM | 3.90 ± 0.97 |
| Crenolanib | 3 uM | 2.25 ± 0.45 |
| Crenolanib | 10 uM | 3.74 ± 1.41 |
| BAY 87-2243 | 0.3 uM | 3.32 ± 0.53 |
| BAY 87-2243 | 1 uM | 5.11 ± 1.08 |
| BAY 87-2243 | 3 uM | 5.48 ± 3.12 |
| BAY 87-2243 | 10 uM | 5.69 ± 2.90 |
| Mubritinib | 0.3 uM | 1.78 ± 0.84 |
| Mubritinib | 1 uM | 2.62 ± 0.43 |
| Mubritinib | 0 uM | 3.43 ± 0.61 |
| Mubritinib | 10 uM | 4.72 ± 1.51 |
| PF-00562271 | 3 uM | 2.33 ± 0.58 |
| PF-00562271 | 10 uM | 4.70 ± 0.49 |

Figure 11:
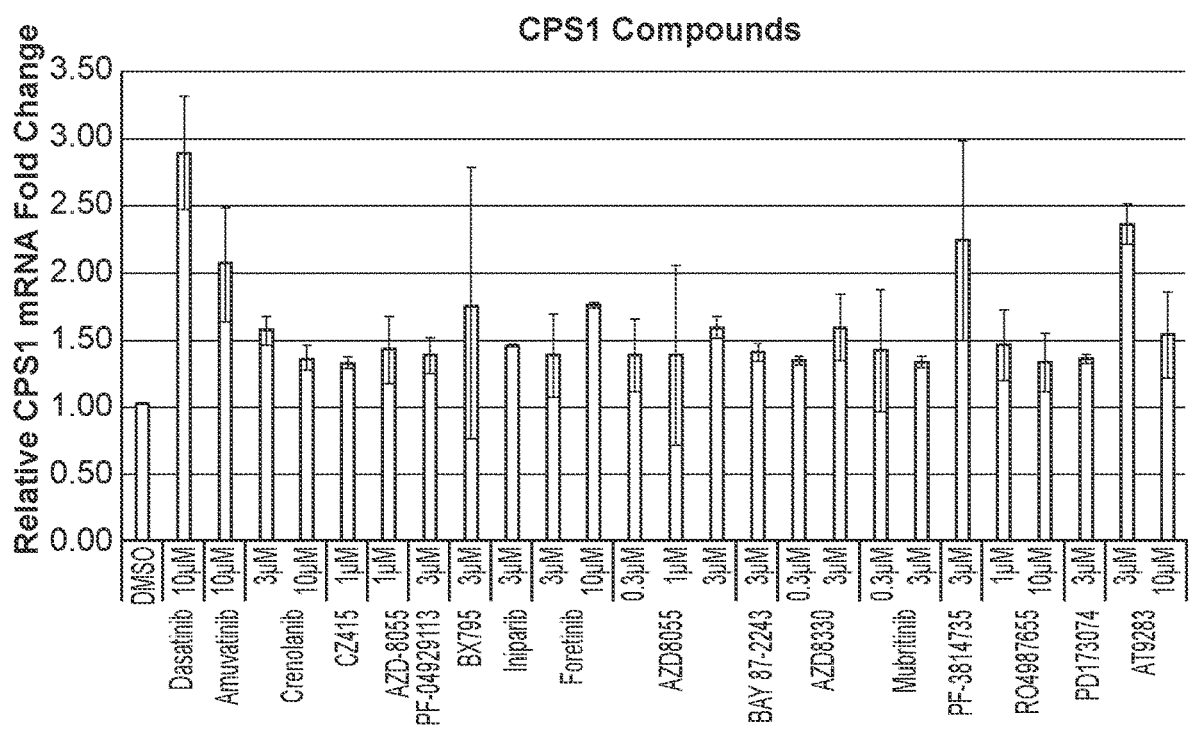
FIG. 11 shows CPS1 gene expression after treatment with the indicated compounds.
Figure 12:
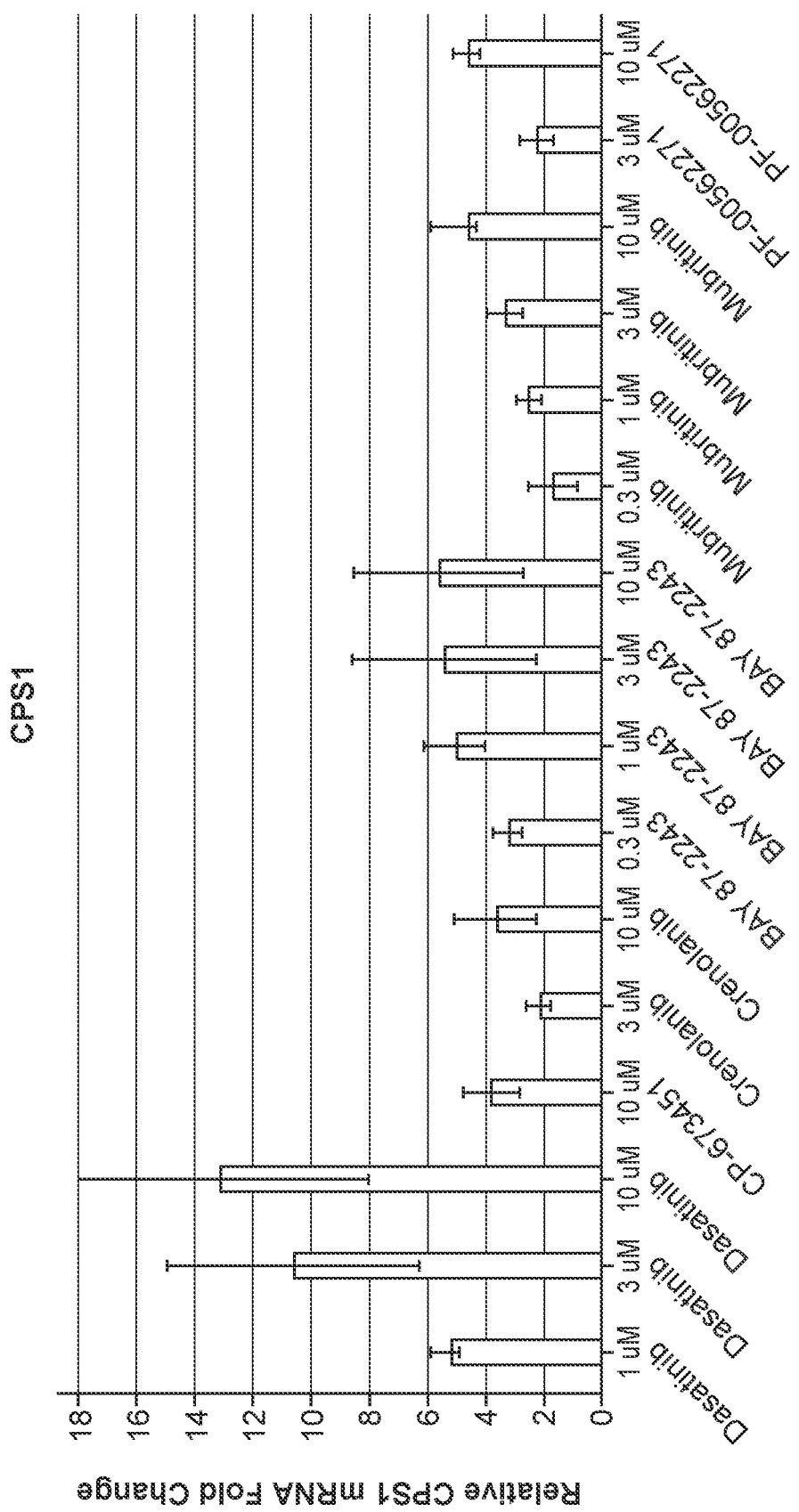
FIG. 12 shows CPS1 gene expression after treatment with the indicated compounds.

The CPS1 results for Table 19 are also shown in FIG. 11 and for Table 20 in FIG. 12. Treatment with Dasatinib, BAY 87-2243, Mubritinib, and PF-00562271 resulted in the greatest increase in CPS1 gene expression.

Tables 21 and 22 provides the relative fold change for compounds that were observed to increase the expression of NAGS, which is associated with NAGS deficiency.

TABLE 21

NAGS expression modulated by compounds

| Compound | Concentration, μM | Relative NAGS level vs Untreated (±Standard Deviation) |
|---|---|---|
| Momelotinib | 10 μM | 1.59 ± 0.09 |
| CZ415 | 10 μM | 2.00 ± 0.27 |
| AZD-8055 | 10 μM | 1.43 ± 0.01 |
| OSI-027 | 0.3 μM | 1.46 ± 0.07 |

TABLE 21-continued

NAGS expression modulated by compounds

| Compound | Concentration, μM | Relative NAGS level vs Untreated (±Standard Deviation) |
|---|---|---|
| OSI-027 | 1 μM | 1.37 ± 0.27 |
| OSI-027 | 3 μM | 2.51 ± 0.16 |
| OSI-027 | 10 μM | 2.14 ± 0.12 |
| BIIB021 | 0.3 μM | 1.38 ± 0.12 |
| Sunitinib | 0.3 μM | 1.40 ± 0.03 |
| Sunitinib | 1 μM | 1.63 ± 0.42 |
| Linifanib | 3 μM | 1.32 ± 0.04 |
| Luminespib | 1 μM | 1.32 ± 0.30 |
| Iniparib | 0.3 μM | 1.41 ± 0.00 |
| Iniparib (BSI- | 3 μM | 1.35 ± 0.27 |
| Foretinib | 10 μM | 1.45 ± 0.38 |
| AZD8055 | 0.3 μM | 1.31 ± 0.20 |
| AZD8055 | 1 μM | 1.41 ± 0.28 |
| AZD8055 | 10 μM | 1.93 ± 0.02 |
| Pioglitazone HCl | 0.3 μM | 1.33 ± 0.02 |
| Mubritinib | 0.3 μM | 1.32 ± 0.15 |
| Mubritinib | 1 μM | 1.72 ± 0.13 |
| Mubritinib | 3 μM | 1.44 ± 0.09 |
| Voxtalisib | 0.3 μM | 1.35 ± 0.04 |
| Voxtalisib | 3 μM | 1.33 ± 0.15 |
| Voxtalisib | 10 μM | 1.78 ± 0.04 |
| Lifirafenib | 0.3 μM | 1.35 ± 0.35 |
| Lifirafenib | 10 μM | 1.44 ± 0.15 |
| PD173074 | 10 μM | 1.30 ± 0.31 |
| AT9283 | 0.3 μM | 1.43 ± 0.38 |
| AT9283 | 1 μM | 1.49 ± 0.10 |
| AT9283 | 3 μM | 1.38 ± 0.07 |

TABLE 22

NAGS expression modulated by compounds

| Compound | Concentration, μM | Relative NAGS level vs Untreated (±Standard Deviation) |
|---|---|---|
| Mubritinib | 0.3 uM | 3.05 ± 2.97 |
| Mubritinib | 1 uM | 2.10 ± 0.82 |

Figure 13:
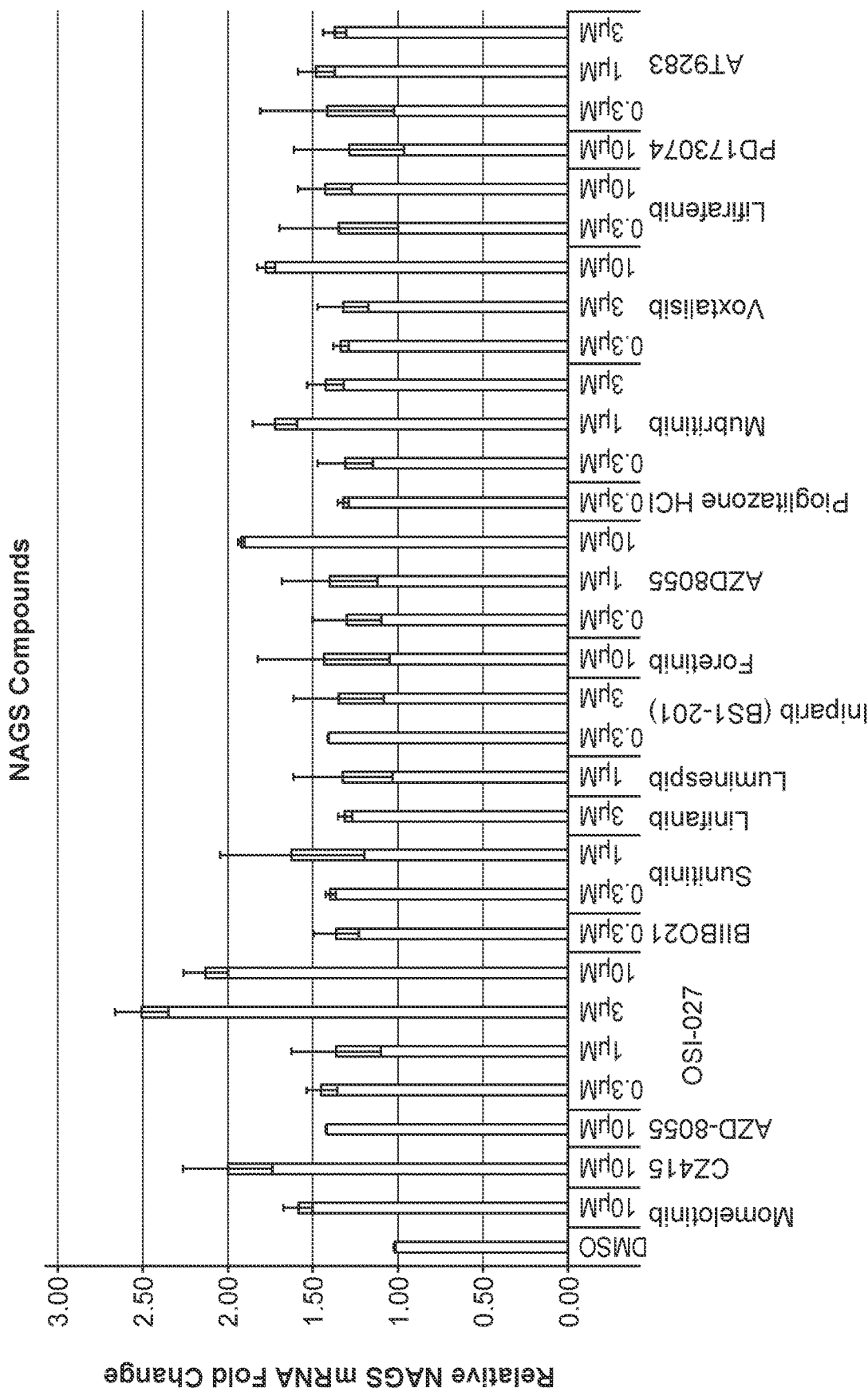
FIG. 13 shows NAGS gene expression after treatment with the indicated compounds.
Figure 14:
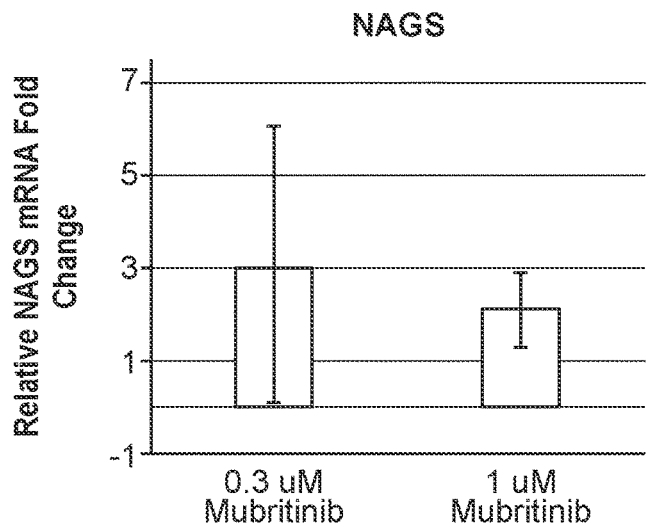
FIG. 14 shows NAGS gene expression after treatment with the indicated compounds.

The NAGS results for Table 21 are also shown in FIG. 13 and for Table 22 in FIG. 14. Treatment with OSI-027, CZ415, and AZD8055 resulted in the greatest increase in NAGS gene expression.

Table 23 provides the relative fold change for compounds that were observed to increase the expression of SLC25A13, which is associated with citrin deficiency.

TABLE 23

SLC25A13 expression modulated by compounds

| Compound | Concentration, μM | Relative SLC25A13 level vs Untreated (±Standard Deviation) |
|---|---|---|
| CZ415 | 3 μM | 1.61 ± 0.19 |
| CZ415 | 10 μM | 1.52 ± 0.17 |
| AZD-8055 | 3 μM | 1.35 ± 0.06 |
| AZD-8055 | 10 μM | 1.64 ± 0.09 |
| OSI-027 | 1 μM | 1.53 ± 0.01 |
| OSI-027 | 3 μM | 1.87 ± 0.46 |
| OSI-027 | 10 μM | 1.52 ± 0.04 |
| BIIB021 | 1 μM | 1.34 ± 0.04 |
| BIIB021 | 3 μM | 1.52 ± 0.24 |
| BIIB021 | 10 μM | 1.41 ± 0.48 |
| 17-AAG | 0.3 μM | 1.48 ± 0.01 |
| 17-AAG | 1 μM | 1.40 ± 0.05 |
| 17-AAG | 3 μM | 1.51 ± 0.09 |
| 17-AAG | 10 μM | 1.46 ± 0.14 |

TABLE 23-continued

SLC25A13 expression modulated by compounds

| Compound | Concentration, µM | Relative SLC25A13 level vs Untreated (±Standard Deviation) |
|---|---|---|
| Luminespib | 10 µM | 1.55 ± 0.02 |
| AZD8055 | 3 µM | 1.33 ± 0.06 |
| AZD8055 | 10 µM | 1.54 ± 0.12 |
| Mubritinib | 0.3 µM | 1.34 ± 0.33 |
| Lifirafenib | 10 µM | 1.92 ± 0.11 |
| Retaspimycin Hydrochloride | 0.3 µM | 1.35 ± 0.27 |
| Retaspimycin Hydrochloride | 1 µM | 1.31 ± 0.08 |
| Retaspimycin Hydrochloride | 3 µM | 1.54 ± 0.17 |
| Retaspimycin Hydrochloride | 10 µM | 1.45 ± 0.01 |

Figure 15:
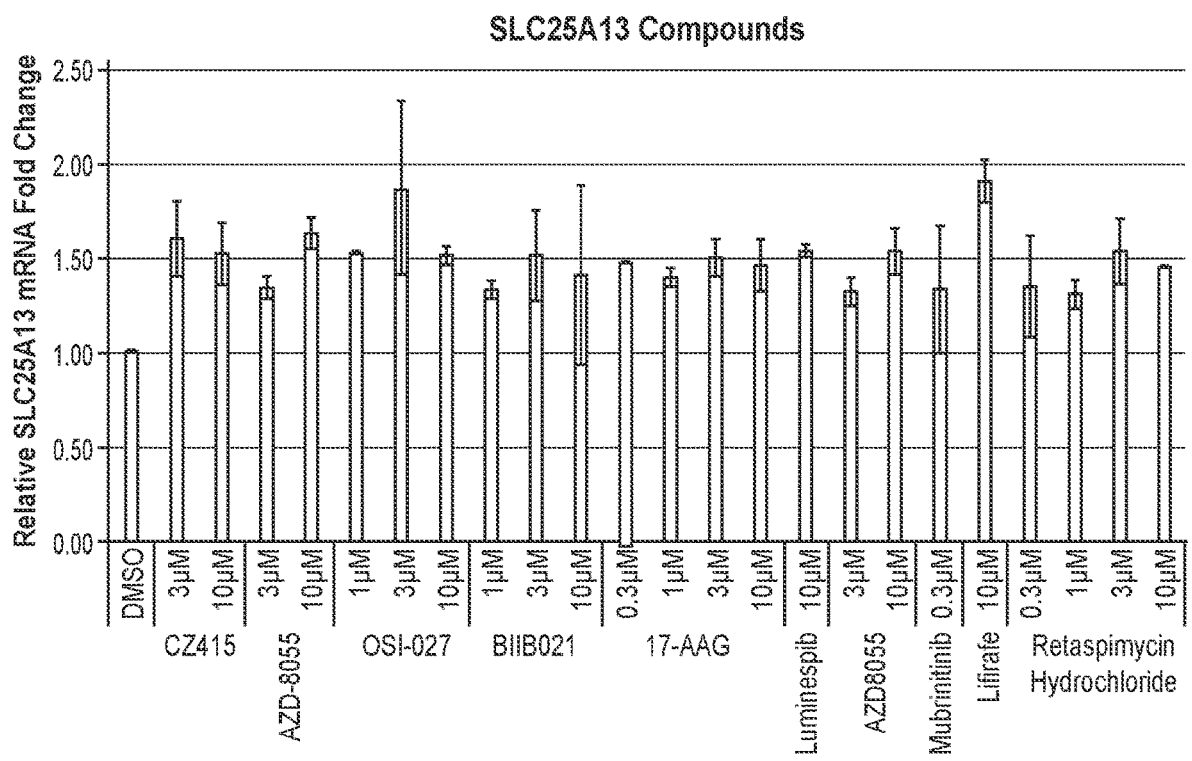
FIG. 15 shows SLC25A13 gene expression after treatment with the indicated compounds.

The SLC25A13 results for Table 23 are also shown in FIG. 15. Treatment with OSI-027 and Lifirafenib resulted in the greatest increase in SLC25A13 gene expression.

Table 24 provides the relative fold change for compounds that were observed to increase the expression of SLC25A15, which is associated with ORNT1 deficiency.

TABLE 24

SLC25A15 expression modulated by compounds

| Compound | Concentration, µM | Relative SLC25A15 level vs Untreated (±Standard Deviation) |
|---|---|---|
| CZ415 | 3 µM | 1.61 ± 0.19 |
| CZ415 | 10 µM | 1.52 ± 0.17 |
| AZD-8055 | 3 µM | 1.3 ± 0.06 |
| AZD-8055 | 10 µM | 1.64 ± 0.09 |
| OSI-027 | 1 µM | 1.53 ± 0.01 |
| OSI-027 | 3 µM | 1.87 ± 0.46 |
| OSI-027 | 10 µM | 1.52 ± 0.04 |
| BIIB021 | 1 µM | 1.34 ± 0.04 |
| BIIB021 | 3 µM | 1.52 ± 0.24 |
| BIIB021 | 10 µM | 1.41 ± 0.48 |
| 17-AAG | 0.3 µM | 1.48 ± 0.01 |
| 17-AAG | 1 µM | 1.40 ± 0.05 |
| 17-AAG | 3 µM | 1.51 ± 0.09 |
| 17-AAG | 10 µM | 1.46 ± 0.14 |
| Luminespib | 10 µM | 1.55 ± 0.02 |
| AZD8055 | 3 µM | 1.33 ± 0.06 |
| AZD8055 | 10 µM | 1.54 ± 0.12 |
| Mubritinib | 0.3 µM | 1.34 ± 0.33 |
| Lifirafenib | 10 µM | 1.92 ± 0.11 |
| Retaspimycin Hydrochloride | 0.3 µM | 1.35 ± 0.27 |
| Retaspimycin Hydrochloride | 1 µM | 1.31 ± 0.08 |
| Retaspimycin Hydrochloride | 3 µM | 1.54 ± 0.17 |
| Retaspimycin Hydrochloride | 10 µM | 1.45 ± 0.01 |
| Sunitinib | 0.3 µM | 1.32 ± 0.08 |
| Sunitinib | 3 µM | 2.36 ± 0.20 |
| Sunitinib | 10 µM | 2.43 ± 0.29 |
| Luminespib | 3 µM | 1.32 ± 0.24 |
| Luminespib | 10 µM | 1.82 ± 0.08 |
| Foretinib | 10 µM | 1.97 ± 0.15 |
| AZD8055 | 3 µM | 1.85 ± 0.26 |
| AZD8055 | 10 µM | 1.68 ± 0.26 |
| BAY 87-2243 | 0.3 µM | 2.85 ± 0.23 |
| BAY 87-2243 | 1 µM | 2.40 ± 0.22 |
| BAY 87-2243 | 3 µM | 2.89 ± 0.37 |
| BAY 87-2243 | 10 µM | 2.70 ± 0.19 |
| Mubritinib | 0.3 µM | 1.72 ± 0.47 |
| Mubritinib | 1 µM | 3.16 ± 0.23 |
| Mubritinib | 3 µM | 3.62 ± 0.29 |
| Mubritinib | 10 µM | 3.38 ± 0.08 |
| Lifirafenib | 10 µM | 2.00 ± 0.13 |
| R1487 Hydrochloride | 1 µM | 1.56 ± 0.16 |
| R1487 Hydrochloride | 10 µM | 1.51 ± 0.09 |
| PF-3814735 | 1 µM | 1.35 ± 0.11 |
| PF-3814735 | 3 µM | 3.06 ± 0.51 |
| PF-3814735 | 10 µM | 2.41 ± 0.14 |
| RO4987655) | 10 µM | 1.31 ± 0.13 |
| PD173074 | 3 µM | 1.30 ± 0.12 |
| AS602801 | 10 µM | 2.22 ± 0.24 |
| SB1317/TG02 | 0.3 µM | 1.36 ± 0.24 |
| SB1317/TG02 | 3 µM | 2.70 ± 0.34 |
| SB1317/TG02 | 10 µM | 2.71 ± 0.09 |
| AT9283 | 1 µM | 1.78 ± 0.04 |
| AT9283 | 3 µM | 2.56 ± 1.37 |
| AT9283 | 10 µM | 2.94 ± 0.98 |
| Retaspimycin Hydrochloride | 0.3 µM | 1.60 ± 0.25 |
| Retaspimycin Hydrochloride | 1 µM | 1.67 ± 0.17 |
| Retaspimycin Hydrochloride | 3 µM | 1.93 ± 0.13 |
| Retaspimycin Hydrochloride | 10 µM | 1.77 ± 0.11 |

Figure 16A:
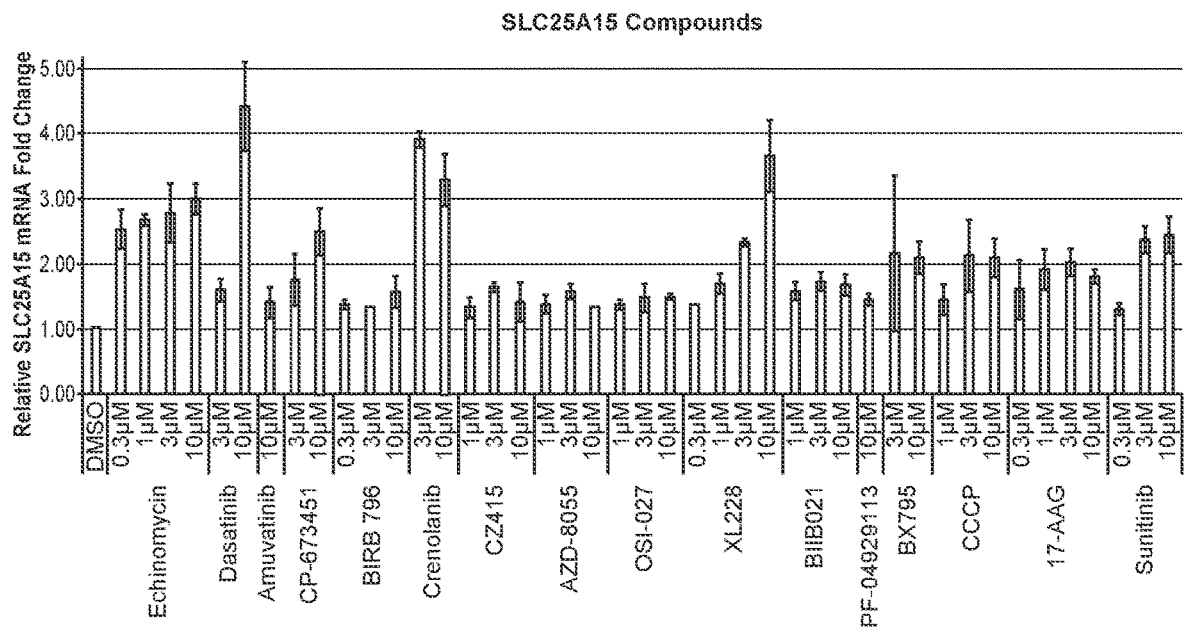
FIG. 16A and FIG. 16B show SLC25A15 gene expression after treatment with the indicated compounds.
Figure 16B:
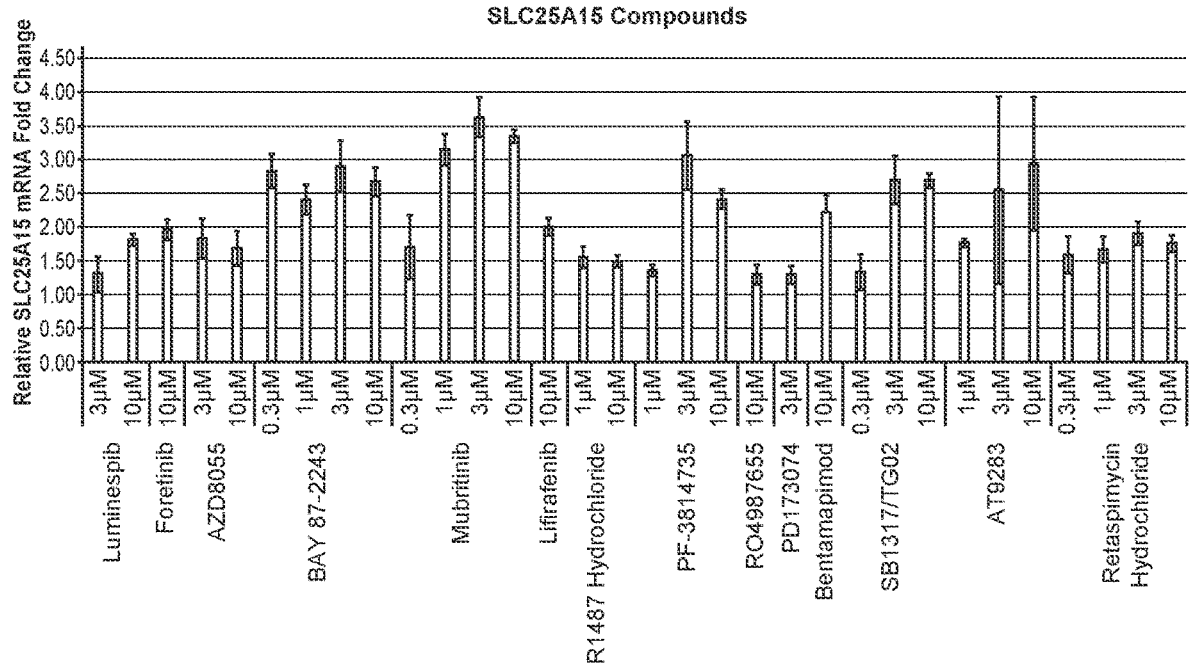

The SLC25A13 results for Table 24 are also shown in FIG. 16A-B. Treatment with Dasatinib, Crenolanib, XL228, Echinomycin, Mubritinib, BAY 87-2243, PF-3814735, and AT9283 resulted in the greatest increase in SLC25A13 gene expression.

Table 25 provides the relative fold change for compounds that were observed to increase the expression of ASL, which is associated with ASL deficiency.

TABLE 25

ASL expression modulated by compounds

| Compound | Concentration, µM | Relative ASL level vs Untreated (±Standard Deviation) |
|---|---|---|
| Dasatinib | 3 uM | 1.50 ± 0.22 |
| Dasatinib | 10 uM | 1.63 ± 0.49 |
| CP-673451 | 10 uM | 2.94 ± 0.78 |
| Crenolanib | 3 uM | 1.69 ± 0.71 |
| Crenolanib | 10 uM | 4.19 ± 1.77 |
| BAY 87-2243 | 0.3 uM | 3.02 ± 0.25 |
| BAY 87-2243 | 1 uM | 7.50 ± 1.10 |
| BAY 87-2243 | 3 uM | 11.42 ± 6.31 |
| BAY 87-2243 | 10 uM | 12.28 ± 4.98 |
| Mubritinib | 0.3 uM | 1.53 ± 0.83 |
| Mubritinib | 1 uM | 2.28 ± 0.31 |
| Mubritinib | 3 uM | 2.11 ± 0.48 |
| Mubritinib | 10 uM | 3.40 ± 1.41 |
| PF-00562271 | 3 uM | 2.09 ± 0.67 |
| PF-00562271 | 10 uM | 4.92 ± 1.05 |

Figure 17:
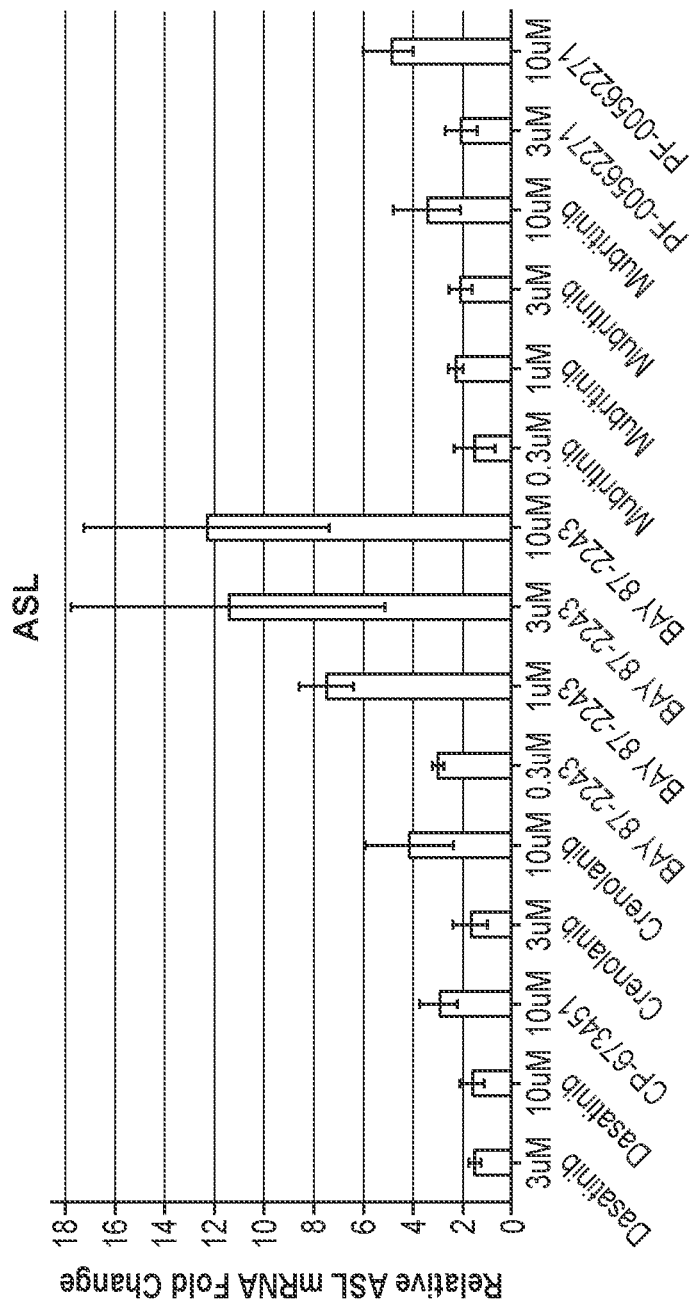
FIG. 17 shows ASL gene expression after treatment with the indicated compounds.

The ASL results for Table 25 are also shown in FIG. 17. Treatment with Crenolanib, BAY 87-2243, and PF-00562271 resulted in the greatest increase in ASL gene expression.

Example 12: JAK Inhibition Increases OTC and CPS1 Expression In Vitro

Additional small molecules that inhibit JAK1, JAK2, JAK3, or a combination of the JAK proteins were tested in primary human hepatocytes as described in Example 2. JAK inhibitors were tested in triplicate at 0.3 µM and 3 µM. The results are shown as the fold change (mRNA FC) in the mRNA levels of OTC and CPS1 genes after treatment compared to an untreated control (DMSO) and the standard deviation (SD).

TABLE 26

| JAK Inhibitors | | |
|---|---|---|
| Compound Name | CAS Number | Target |
| Upadacitinib | 1310726-60-3 | JAK1 |
| Oclacitinib maleate | 1208319-26-9 | JAK1 |
| GLPG0634 analog | 1206101-20-3 | JAK1 |
| LYS2784544 | 1229236-86-5 | JAK1 |
| ruxolitinib | 941678-49-5 | JAK1 & 2 |
| itacitinib | 1334298-90-6 | JAK1 & 2 |
| baricitinib | 1187594-09-7 | JAK1 & 2 |
| AZD1480 | 935666-88-9 | JAK1 & 2 |
| GLPG0634/Filgotinib | 1206161-97-8 | JAK1 & 2 |

TABLE 26-continued

| JAK Inhibitors | | |
|---|---|---|
| Compound Name | CAS Number | Target |
| BMS-911543 | 1271022-90-2 | JAK1 & 2 |
| tofacitinib | 477600-75-2 | Pan-JAK |
| CP690550 citrate | 540737-29-9 | Pan-JAK |
| cerdulatinib | 1198300-79-6 | Pan-JAK |
| Decernotinib | 944842-54-0 | Pan-JAK |
| Peficitinib | 944118-01-8 | Pan-JAK |
| PF-06263276 | 1421502-62-6 | Pan-JAK |
| Fedratinib | 936091-26-8 | JAK2 |
| SB1317/TG02 | 937270-47-8 | JAK2 |
| XL019 | 945755-56-6 | JAK2 |
| LY2784544/gandotinib | 1229236-86-5 | JAK2 |
| JANEX-1 | 202475-60-3 | JAK 3 |
| AT9283 | 896466-04-9 | JAK2 & 3 |

Figure 18:
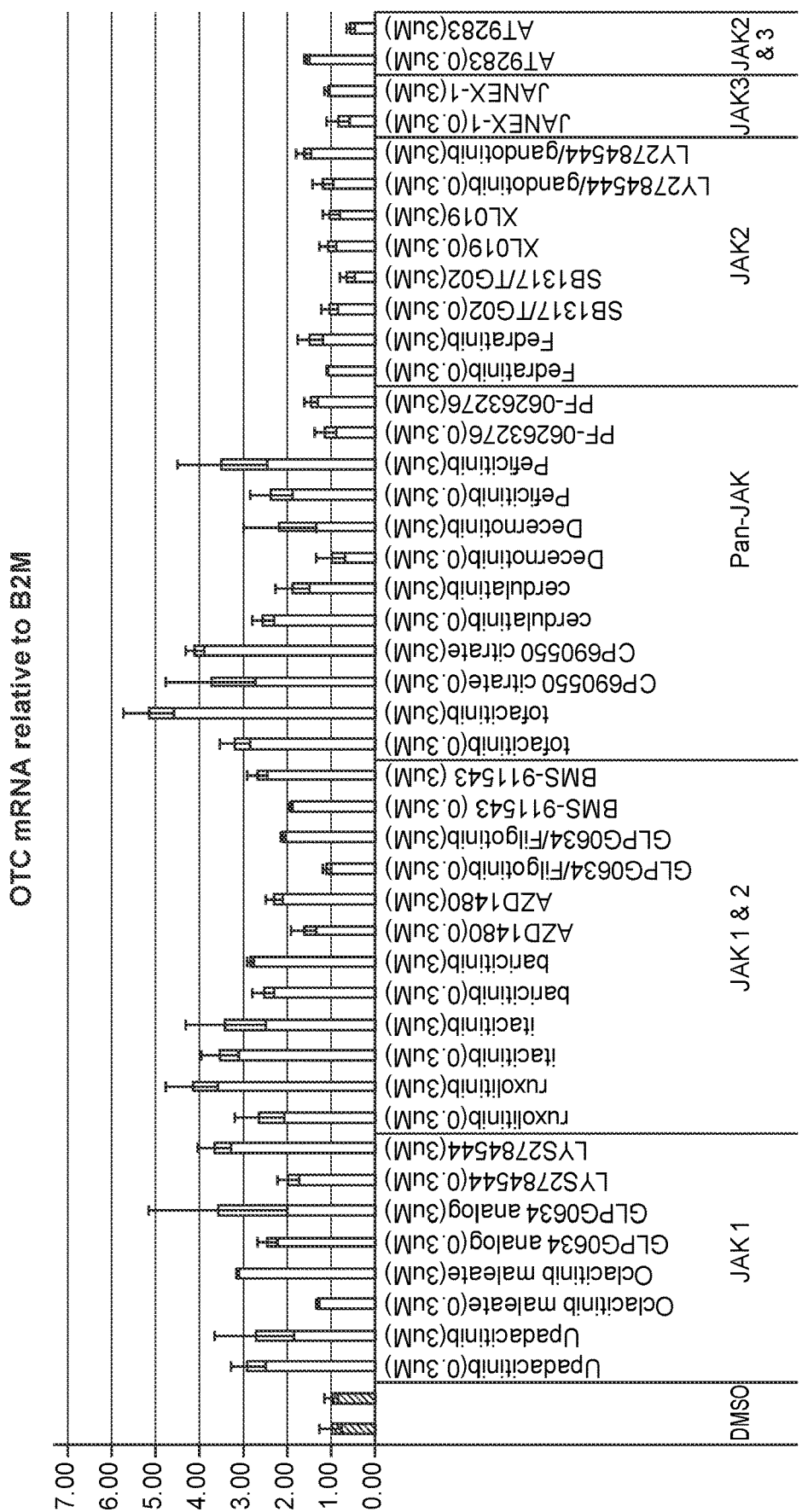
FIG. 18 shows OTC gene expression after treatment with the indicated compounds.

Table 27 and FIG. 18 provide the relative fold change for JAK inhibitory compounds that increased the expression of OTC.

TABLE 27

| Pathway | Treatment | mRNA FC | SD |
|---|---|---|---|
|  | DMSO | 1.03 | 0.25 |
|  | DMSO | 1.01 | 0.15 |
| JAK1 | Upadacitinib (0.3 uM) | 2.91 | 0.39 |
|  | Upadacitinib (3 uM) | 2.75 | 0.9 |
|  | Oclacitinib maleate (0.3 uM) | 1.32 | 0.02 |
|  | Oclacitinib maleate (3 uM) | 3.14 | 0.02 |
|  | GLPG0634 analog (0.3 uM) | 2.46 | 0.24 |
|  | GLPG0634 analog (3 uM) | 3.58 | 1.59 |
|  | LYS2784544 (0.3 uM) | 1.98 | 0.24 |
|  | LYS2784544 (3 uM) | 3.67 | 0.38 |
| JAK1 & 2 | ruxolitinib (0.3 uM) | 2.65 | 0.56 |
|  | ruxolitinib (3 uM) | 4.17 | 0.6 |
|  | itacitinib (0.3 uM) | 3.56 | 0.43 |
|  | itacitinib (3 uM) | 3.41 | 0.91 |
|  | baricitinib (0.3 uM) | 2.56 | 0.24 |
|  | baricitinib (3 uM) | 2.85 | 0.09 |
|  | AZD1480 (0.3 uM) | 1.63 | 0.29 |
|  | AZD1480 (3 uM) | 2.3 | 0.19 |
|  | GLPG0634/Filgotinib (0.3 uM) | 1.12 | 0.1 |
|  | GLPG0634/Filgotinib (3 uM) | 2.11 | 0.07 |
|  | BMS-911543 (0.3 uM) | 1.94 | 0.03 |
|  | BMS-911543 (3 uM) | 2.7 | 0.22 |
|  | BMS-911543 (0.3 uM) | 1.94 | 0.03 |
| Pan-JAK | tofacitinib (0.3 uM) | 3.2 | 0.35 |
|  | tofacitinib (3 uM) | 5.17 | 0.58 |
|  | CP690550 citrate (0.3 uM) | 3.75 | 1.02 |
|  | CP690550 citrate (3 uM) | 4.11 | 0.21 |
|  | cerdulatinib (0.3 uM) | 2.56 | 0.25 |
|  | cerdulatinib (3 uM) | 1.89 | 0.39 |
|  | Decernotinib (0.3 uM) | 1.01 | 0.33 |
|  | Decernotinib (3 uM) | 2.18 | 0.83 |
|  | Peficitinib (0.3 uM) | 2.38 | 0.49 |
|  | Peficitinib (3 uM) | 3.49 | 1 |
|  | PF-06263276 (0.3 uM) | 1.16 | 0.25 |
|  | PF-06263276 (3 uM) | 1.46 | 0.16 |
| JAK2 | Fedratinib (0.3 uM) | 1.09 | 0.02 |
|  | Fedratinib (3 uM) | 1.49 | 0.3 |
|  | SB1317/TG02 (0.3 uM) | 1.05 | 0.19 |
|  | SB1317/TG02 (3 uM) | 0.64 | 0.17 |
|  | XL019 (0.3 uM) | 1.09 | 0.21 |
|  | XL019 (3 uM) | 1.02 | 0.2 |
|  | LY2784544/gandotinib (0.3 uM) | 1.19 | 0.24 |
|  | LY2784544/gandotinib (3 uM) | 1.63 | 0.17 |
| JAK 3 | JANEX-1 (0.3 uM) | 0.85 | 0.27 |
|  | JANEX-1 (3 uM) | 1.1 | 0.05 |
| JAK2 & 3 | AT9283 (0.3 uM) | 1.56 | 0.06 |
|  | AT9283 (3 uM) | 0.56 | 0.09 |

Figure 19:
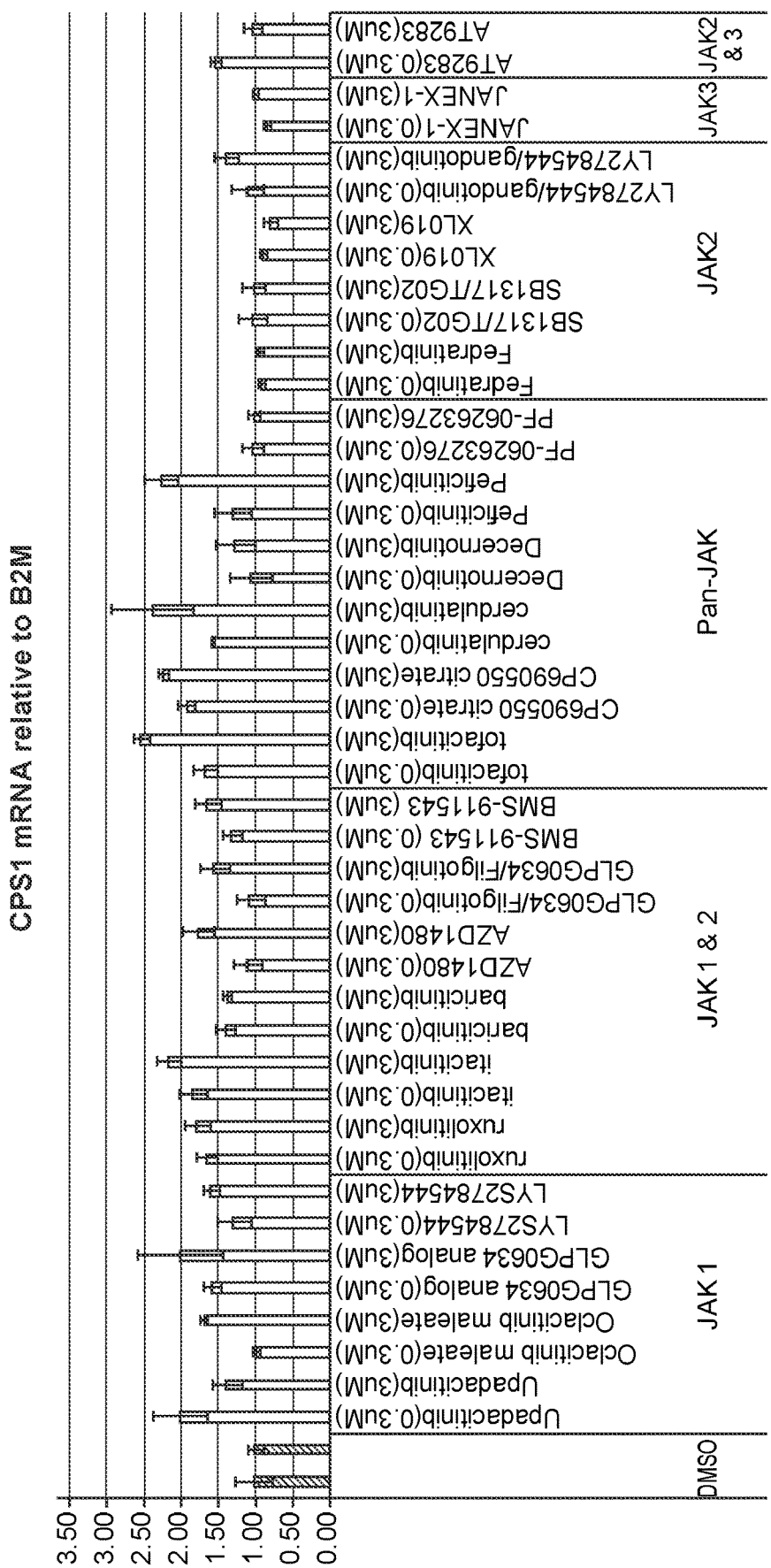
FIG. 19 shows CPS1 gene expression after treatment with the indicated compounds.

Table 28 and FIG. 19 provide the relative fold change for JAK inhibitory compounds that increased the expression of CPS1.

TABLE 28

| Pathway | Treatment | mRNA FC | SD |
|---|---|---|---|
|  | DMSO | 1.03 | 0.25 |
|  | DMSO | 1.01 | 0.11 |
| JAK1 | Upadacitinib (0.3 uM) | 2.02 | 0.38 |
|  | Upadacitinib (3 uM) | 1.39 | 0.2 |
|  | Oclacitinib maleate (0.3 uM) | 1 | 0.05 |
|  | Oclacitinib maleate (3 uM) | 1.69 | 0.05 |
|  | GLPG0634 analog (0.3 uM) | 1.59 | 0.11 |
|  | GLPG0634 analog (3 uM) | 2.02 | 0.57 |
|  | LYS2784544 (0.3 uM) | 1.3 | 0.22 |
|  | LYS2784544 (3 uM) | 1.6 | 0.1 |
| JAK1 & 2 | ruxolitinib (0.3 uM) | 1.66 | 0.14 |
|  | ruxolitinib (3 uM) | 1.79 | 0.18 |
|  | itacitinib (0.3 uM) | 1.84 | 0.2 |
|  | itacitinib (3 uM) | 2.17 | 0.16 |
|  | baricitinib (0.3 uM) | 1.4 | 0.12 |
|  | baricitinib (3 uM) | 1.38 | 0.07 |
|  | AZD1480 (0.3 uM) | 1.1 | 0.19 |
|  | AZD1480 (3 uM) | 1.77 | 0.21 |
|  | GLPG0634/Filgotinib (0.3 uM) | 1.08 | 0.19 |
|  | GLPG0634/Filgotinib (3 uM) | 1.56 | 0.2 |
|  | BMS-911543 (0.3 uM) | 1.31 | 0.13 |
|  | BMS-911543 (3 uM) | 1.65 | 0.18 |
|  | BMS-911543 (0.3 uM) | 1.03 | 0.25 |
| Pan-JAK | tofacitinib (0.3 uM) | 1.67 | 0.16 |
|  | tofacitinib (3 uM) | 2.54 | 0.1 |
|  | CP690550 citrate (0.3 uM) | 1.93 | 0.12 |
|  | CP690550 citrate (3 uM) | 2.24 | 0.07 |
|  | cerdulatinib (0.3 uM) | 1.58 | 0.01 |
|  | cerdulatinib (3 uM) | 2.39 | 0.56 |
|  | Decernotinib (0.3 uM) | 1.07 | 0.27 |
|  | Decernotinib (3 uM) | 1.28 | 0.27 |
|  | Peficitinib (0.3 uM) | 1.31 | 0.24 |
|  | Peficitinib (3 uM) | 2.28 | 0.22 |
|  | PF-06263276 (0.3 uM) | 1.05 | 0.14 |
|  | PF-06263276 (3 uM) | 1.03 | 0.07 |
| JAK2 | Fedratinib (0.3 uM) | 0.93 | 0.04 |
|  | Fedratinib (3 uM) | 0.95 | 0.05 |
|  | SB1317/TG02 (0.3 uM) | 1.05 | 0.19 |
|  | SB1317/TG02 (3 uM) | 1.03 | 0.16 |
|  | XL019 (0.3 uM) | 0.91 | 0.04 |
|  | XL019 (3 uM) | 0.81 | 0.1 |
|  | LY2784544/gandotinib (0.3 uM) | 1.11 | 0.21 |
|  | LY2784544/gandotinib (3 uM) | 1.39 | 0.16 |
| JAK 3 | JANEX-1 (0.3 uM) | 0.86 | 0.05 |
|  | JANEX-1 (3 uM) | 1.01 | 0.04 |
| JAK2 & 3 | AT9283 (0.3 uM) | 1.53 | 0.07 |
|  | AT9283 (3 uM) | 1.05 | 0.12 |

Inhibitors that target JAK1, e.g., the JAK1 specific inhibitors, the Pan-JAK inhibitors, and the JAK1 & 2 inhibitors, increased OTC and CPS1 expression the most. JAK2 and JAK3 inhibitors were less effective at increasing OTC or CPS1 expression.

Figure 20:
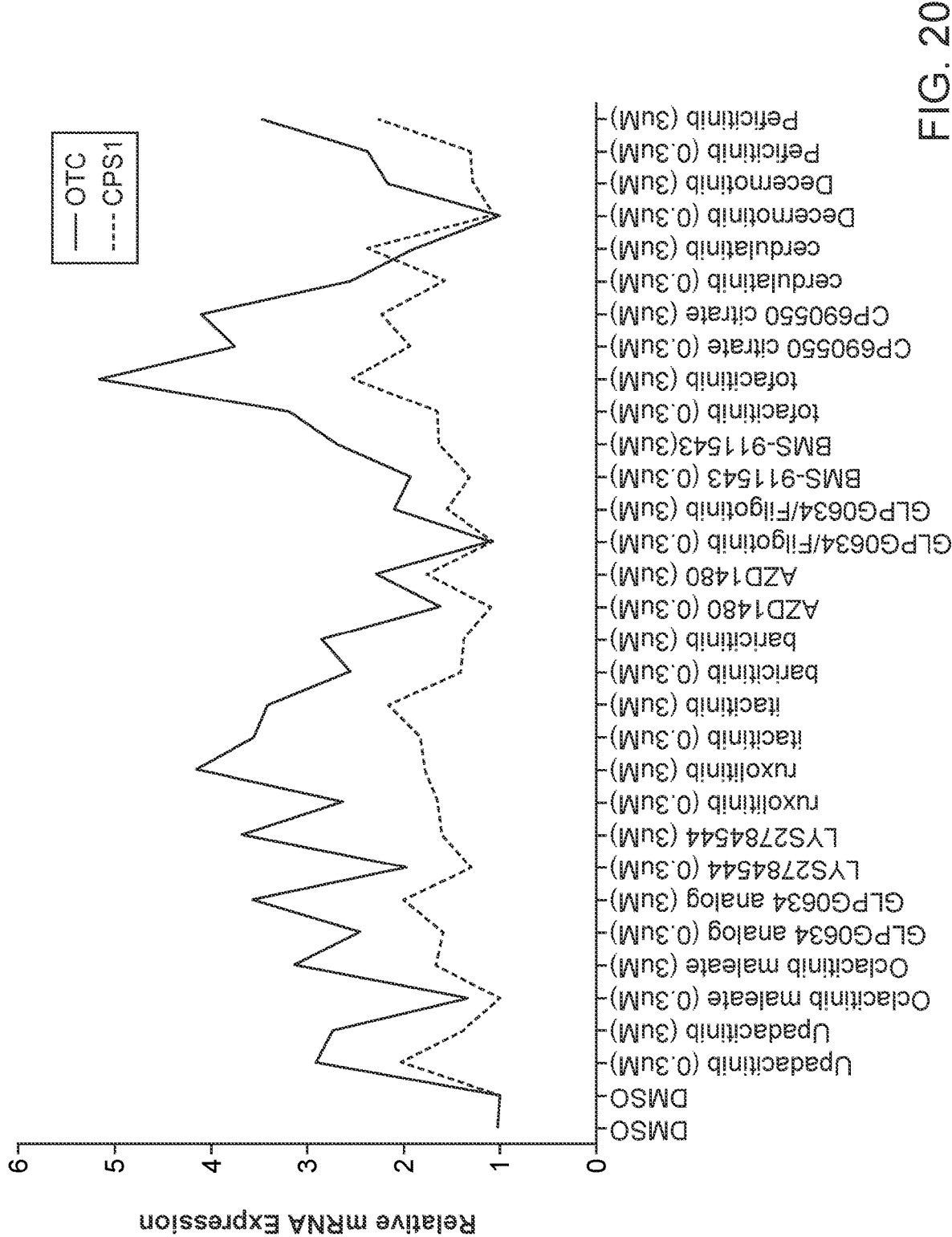
FIG. 20 shows OTC and CPS1 gene expression compared to each other after treatment with the indicated JAK inhibitors that target JAK1. Compounds that increased CPS1 expression also increased OTC expression.

A comparison of the relative mRNA levels of OTC and CPS1 with each inhibitor shows that the JAK1 inhibitors that increased OTC expression also increased CPS1. FIG. 20 shows the relative mRNA expression of OTC and CPS1 after treatment with various JAK1 inhibitors. Thus, JAK1 inhibitors that were effective in increasing one gene were also effective in increasing the other gene.

Next, two JAK1 inhibitors were tested at increasing concentrations in a dose titration assy. Hepatocytes from two different donors (A and B) were incubated with the various concentrations of upadacitinib or oclacitinib maleate and harvested for mRNA analysis. OTC and CPS1 mRNA were normalized to house keeping gene B2M gene expression.

Figure 21A:
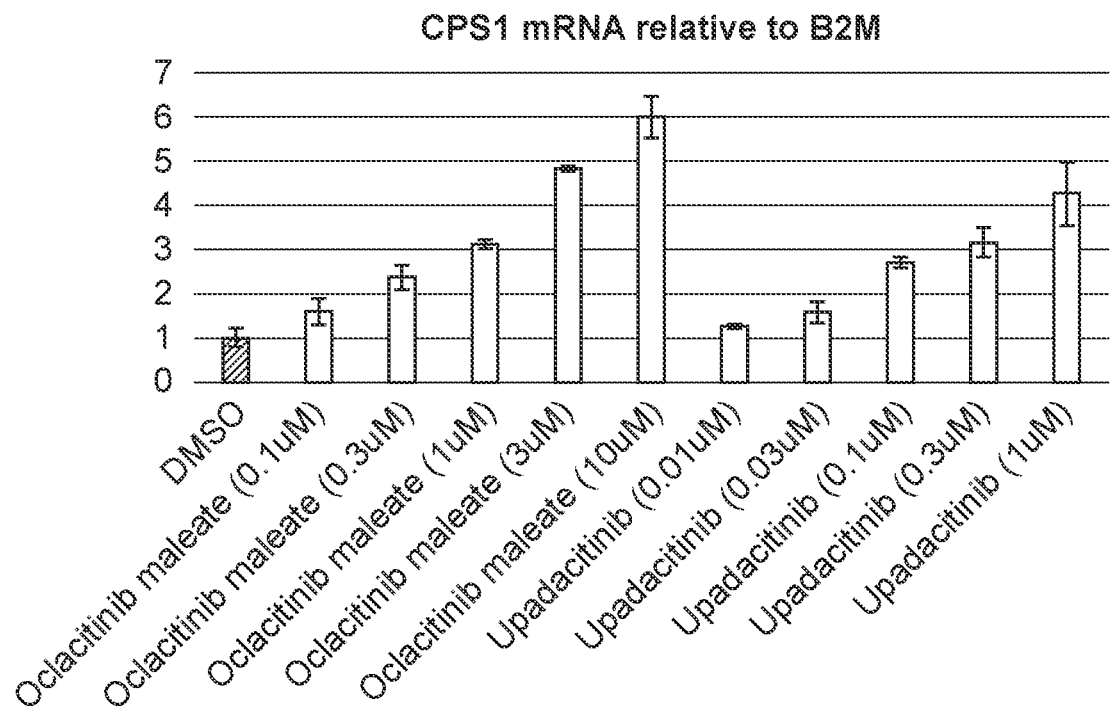
FIG. 21A shows a dose dependent increase in CPS1 expression in hepatocytes in a Donor A cell line after treatment with the indicated compounds.
Figure 21B:
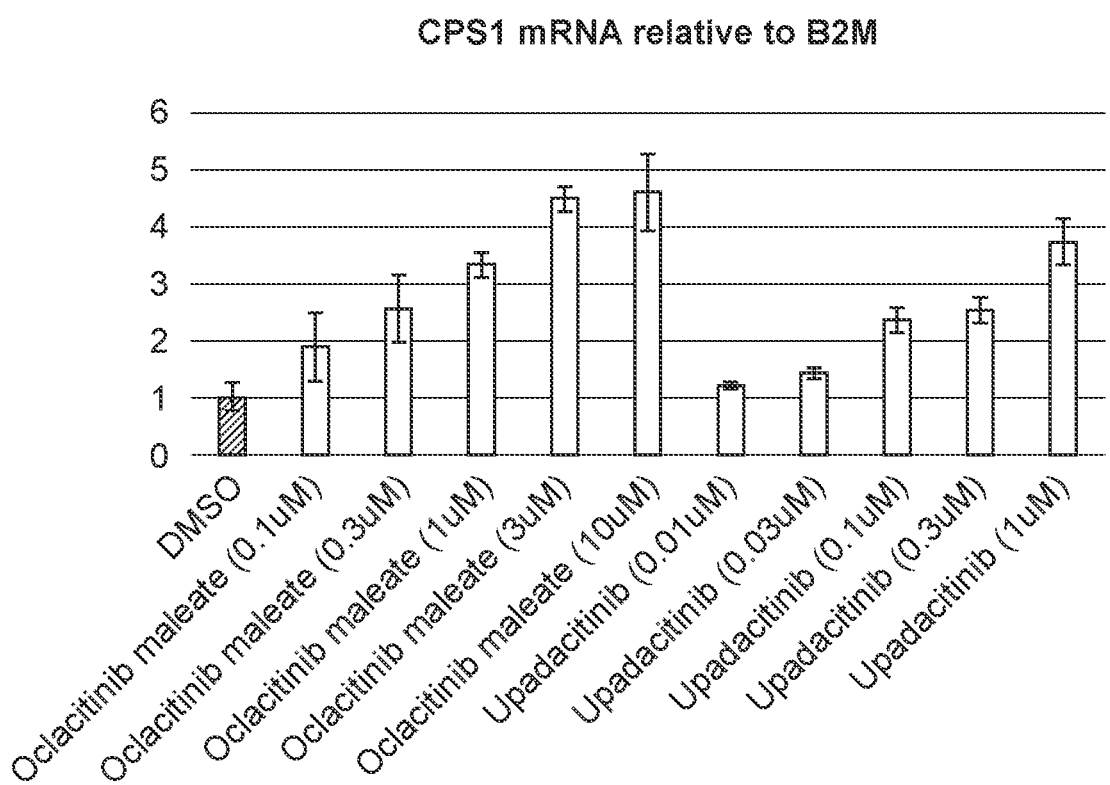
FIG. 21B shows a dose dependent increase in CPS1 expression in hepatocytes in a Donor B cell line after treatment with the indicated compounds.
Figure 21C:
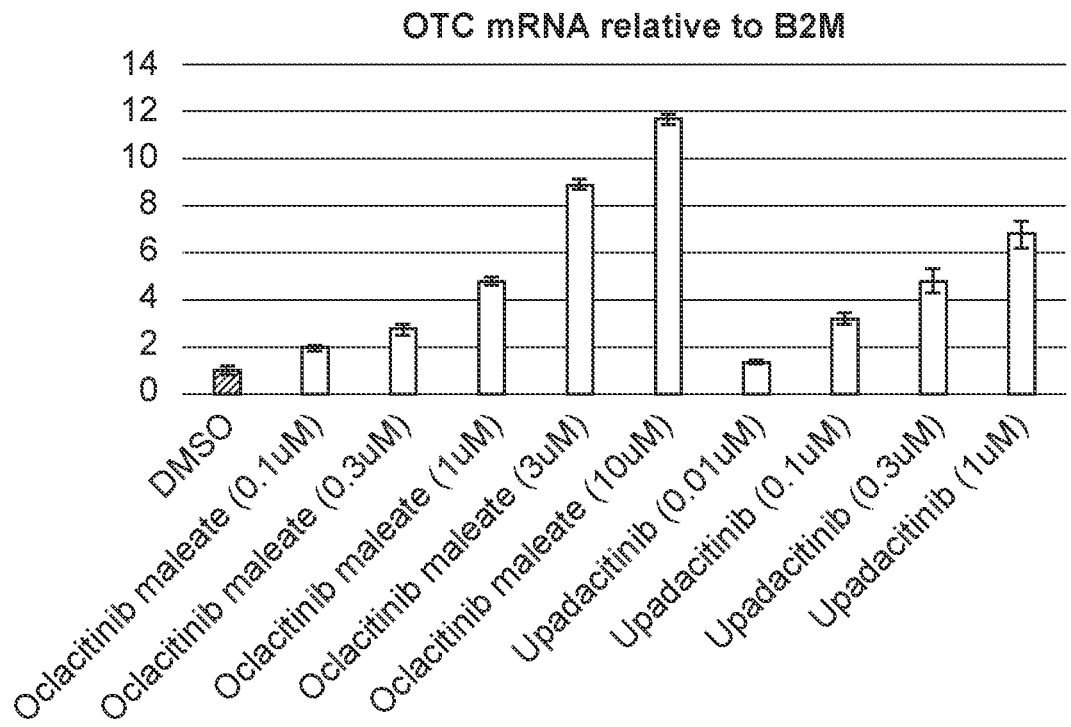
FIG. 21C shows a dose dependent increase in OTC expression in hepatocytes in a Donor A cell line after treatment with the indicated compounds.
Figure 21D:
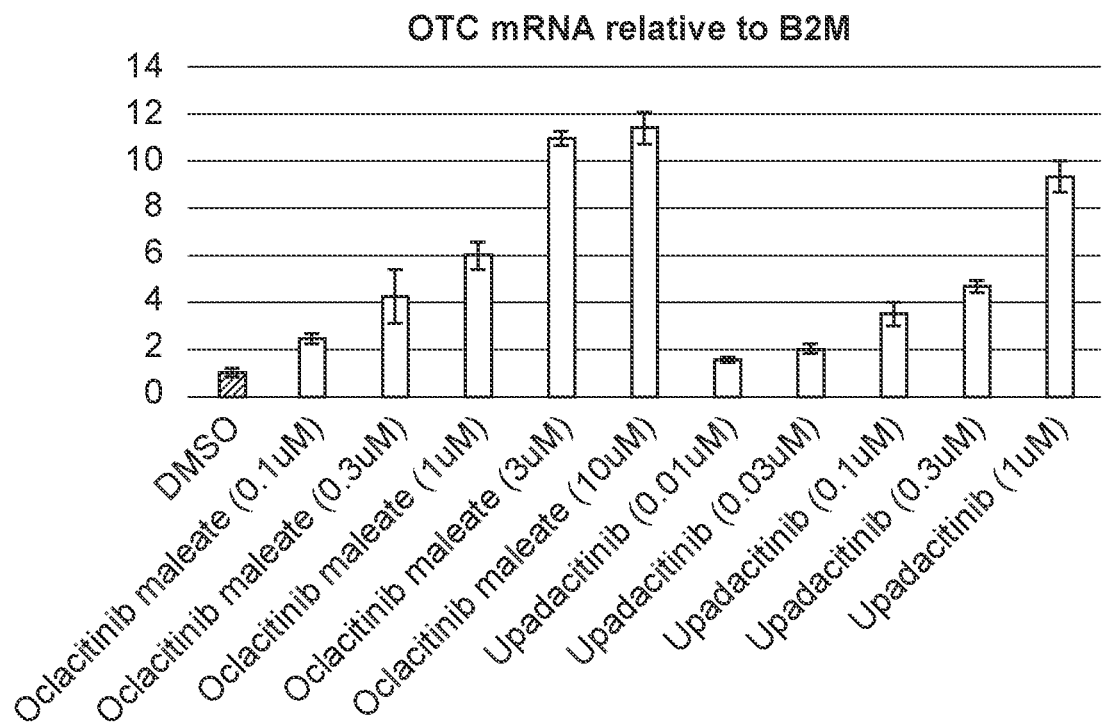
FIG. 21D shows a dose dependent increase in OTC expression in hepatocytes in a Donor B cell line after treatment with the indicated compounds.

Both JAK1 inhibitors upadacitinib and oclacitinib maleate showed a dose dependent increase in CPS1 or OTC mRNA expression in both donor cell lines. FIG. 21A shows CPS1 gene expression in Donor A, FIG. 21B shows CPS1 gene expression in Donor B, FIG. 21C shows OTC gene expression in Donor A, FIG. 21D shows OTC gene expression in Donor B. DMSO was used as a control. Table 29 shows the CPS1 and OTC mRNA fold change and standard deviation (SD) in each donor cell line.

TABLE 29

| Treatment | mRNA FC | SD | mRNA FC | SD |
|---|---|---|---|---|
| | CPS1 mRNA, Donor A | | CPS1 mRNA, Donor B | |
| DMSO | 1.02 | 0.21 | 1.02 | 0.25 |
| Oclacitinib maleate (0.1 uM) | 1.61 | 0.28 | 4.60 | 0.68 |
| Oclacitinib maleate (0.3 uM) | 2.37 | 0.28 | 4.50 | 0.22 |
| Oclacitinib maleate (1 uM) | 3.12 | 0.10 | 3.34 | 0.22 |
| Oclacitinib maleate (3 uM) | 4.82 | 0.04 | 2.57 | 0.57 |
| Oclacitinib maleate (10 uM) | 5.99 | 0.47 | 1.90 | 0.59 |
| Upadacitinib (0.1 uM) | 1.26 | 0.02 | 3.74 | 0.41 |
| Upadacitinib (0.3 uM) | 1.58 | 0.23 | 2.54 | 0.22 |
| Upadacitinib (1 uM) | 2.70 | 0.12 | 2.38 | 0.22 |
| Upadacitinib (3 uM) | 3.15 | 0.32 | 1.43 | 0.09 |
| Upadacitinib (10 uM) | 4.25 | 0.71 | 1.21 | 0.06 |
| | OTC mRNA, Donor A | | OTC mRNA, Donor B | |
| DMSO | 1.02 | 0.21 | 1.01 | 0.15 |
| Oclacitinib maleate (0.1 uM) | 1.97 | 0.13 | 2.46 | 0.22 |
| Oclacitinib maleate (0.3 uM) | 2.76 | 0.24 | 4.28 | 1.11 |
| Oclacitinib maleate (1 uM) | 4.79 | 0.16 | 5.97 | 0.55 |
| Oclacitinib maleate (3 uM) | 8.92 | 0.22 | 11.00 | 0.31 |
| Oclacitinib maleate (10 uM) | 11.65 | 0.23 | 11.46 | 0.71 |
| Upadacitinib (0.1 uM) | 1.36 | 0.05 | 1.56 | 0.10 |
| Upadacitinib (0.3 uM) | 1.99 | 0.33 | 2.06 | 0.17 |
| Upadacitinib (1 uM) | 3.17 | 0.24 | 3.54 | 0.52 |
| Upadacitinib (3 uM) | 4.81 | 0.51 | 4.66 | 0.23 |
| Upadacitinib (10 uM) | 6.77 | 0.56 | 9.39 | 0.64 |

To confirm that JAK1 inhibition is necessary for OTC and CPS1 gene expression increase, JAK1, JAK2, and JAK3 expression was knocked down using the siRNA methods previously described in Example 1 (JAK1 siRNA Dharmacon #M-003145-02-0005; JAK2 siRNA Dharmacon #M-003146-02-0005; JAK3 siRNA Dharmacon #M-003147-01-0005). The cells were harvest for mRNA collection and quantification as previously described.

Figure 22B:
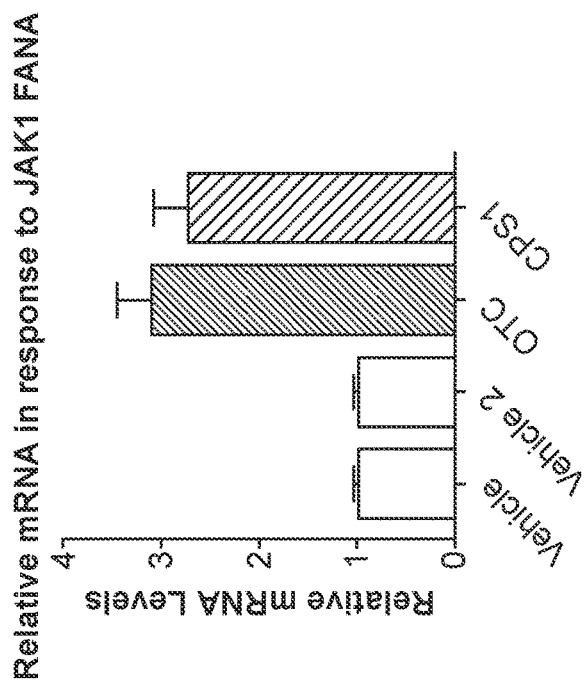
FIG. 22B shows that JAK1 knockdown after FANA (2'-deoxy-2'-fluoro-beta-D-arabinonucleic acid antisense) RNA treatment increased OTC and CPS1 mRNA expression.
Figure 22D:
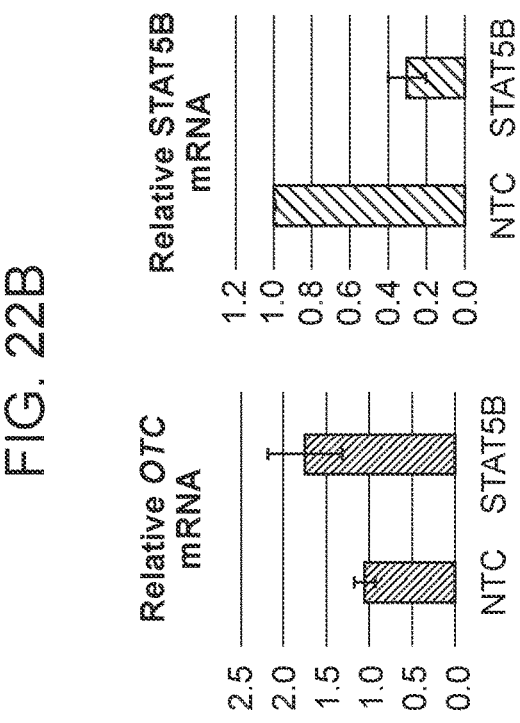
FIG. 22D shows that STAT5B siRNA knockdown increased OTC expression.
Figure 22A:
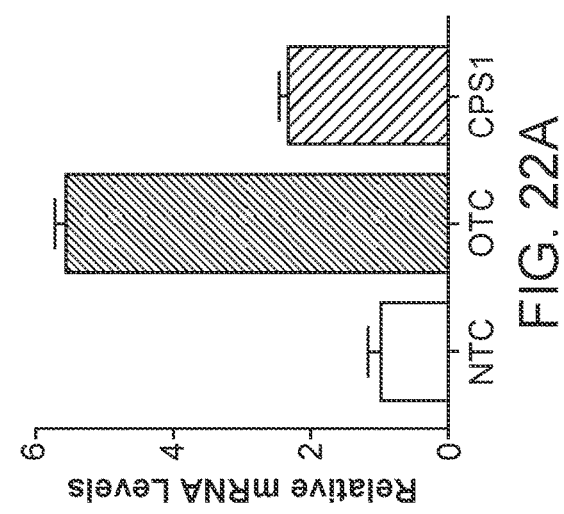
FIG. 22A shows that JAK1 siRNA knockdown increased OTC and CPS1 mRNA expression.

As shown in Table 30 and FIG. 22A, knock down of JAK1 resulted in the greatest increase in OTC and CPS1 mRNA expression, while JAK2 and JAK3 knockdown had minimal effect.

TABLE 30

| Name | siRNA KD* FC | OTC FC OTC | CPS1 FC CSP1 |
|---|---|---|---|
| JAK1 | 0.58 | 1.49 | 1.27 |
| JAK2 | 0.375 | 0.88 | 0.82 |
| JAK3 | 0.366 | 1.00 | 1.10 |

JAK1 was also knocked down using a 2'-deoxy-2'-fluoro-beta-D-arabinonucleic acid antisense RNA oligonucleotide (FANA ASO). Primary human hepatocytes were plated in plating media. 4 hours post plating, the cells were transferred to Cellartis Power Media (Takara Bio) containing 10 uM FANA ASO or a scrambled control. The JAK1 FANA ASO sequence was TTGTAGCTGATGTCCTTGGG. Cells were harvested 5 days post-plating and processed for mRNA measurements for OTC, CPS1 and JAK1.

JAK1 knockdown in hepatocytes using a FANA ASO resulted in similar increases in CPS1 and OTC gene expression (FIG. 22B).

Figure 22C:
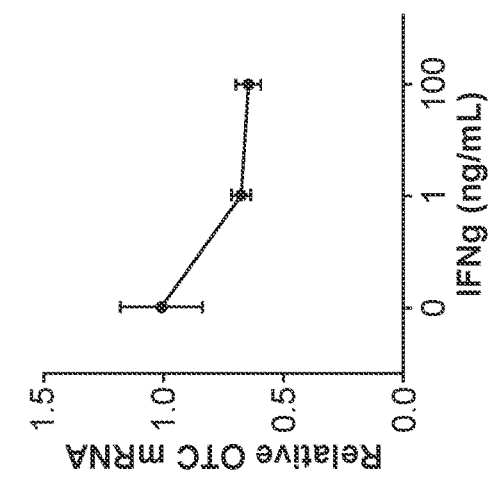
FIG. 22C shows that IFNγ, a JAK activator, decreases OTC expression in hepatocytes.

To further assess the link between JAK1 and the urea cycle genes, hepatocytes were incubated with increasing concentrations of interferon (IFN)-γ, a known JAK1 activator. The cells were harvested for mRNA collection and OTC gene expression was determined as previously described. As shown in FIG. 22C, incubation with IFN-γ resulted in a dose-dependent decrease in OTC gene expression.

In addition, STAT5B is a JAK1 signal transducer and transcription factor activated by JAK1. STAT5B was knocked down in hepatocytes using siRNA (Dharmacon cat #M-010539-02-0005) as previously described in Example 1. The cells were harvest for mRNA collection and quantification as previously described.

As shown in FIG. 22D, the STA5B siRNA was effective in reducing STAT5B expression (right panel) and OTC expression was increased after STAT5B knockdown (left panel). Thus, decreasing STAT5B expression also increases OTC gene expression.

Figure 23:
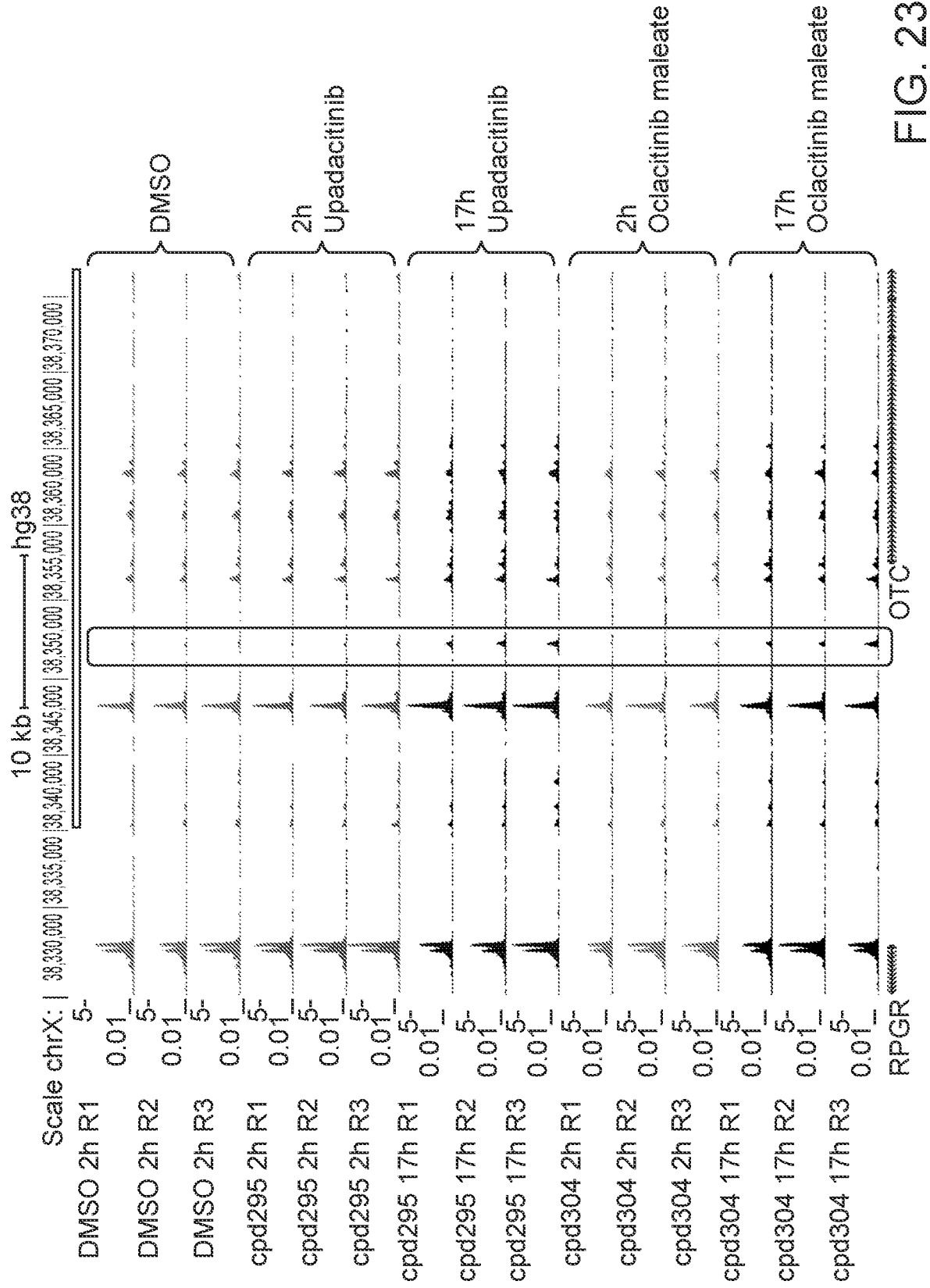
FIG. 23 shows opening of a novel chromatin domain upstream of the OTC gene after treatment with the indicated JAK inhibitors.

The changes in the chromatin structure of the OTC insulated neighborhood after administration of JAK1 inhibitors were also assessed via ATAC-seq as described in Example 1. The ATAC-seq experiment was done in triplicate. As shown in FIG. 23, cells incubated with upadacitinib or oclacitinib maleate showed a newly accessible chromatin domain upstream of the OTC gene after 17 hours of inhibitor treatment.

Next, the link between CPS1 expression and OTC expression was investigated. siRNA targeting CPS1 was added to wells with media and the cells added to the wells (reverse transfection). The next day, the media was refreshed, and in some samples a FANA antisense oligonucleotide (ASO) directed to JAK1 was added to the wells. A scrambled ASO was used as a control for the treatment. After incubating with the JAK1 or scrambled ASO for 48 h, the cells were re-transfected with siRNA targeting CPS1 and incubated overnight (forward transfection) after which the media was refreshed. Cells were further incubated for 24 hours and harvested for analysis of the CPS1, OTC, and JAK1 mRNA expression levels. Similar methods were used to prepare cells with only the JAK1 FANA treatment and the CPS1 forward transfection, or only the CPS1 forward transfection. Scrambled RNA (NTC) was used as a control for CPS1 knockdown.

Figure 24B:
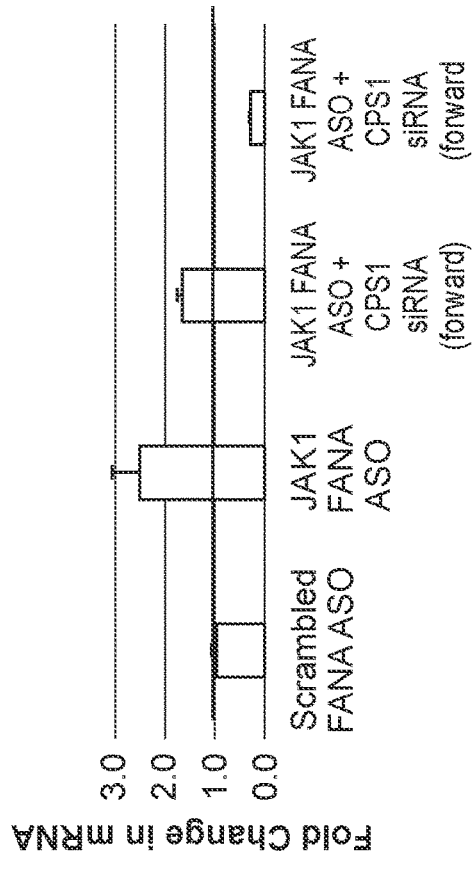
FIG. 24B shows CPS1 expression after treatment with JAK1 FANA, or both JAK1 FANA and CPS1 siRNA.
Figure 24D:
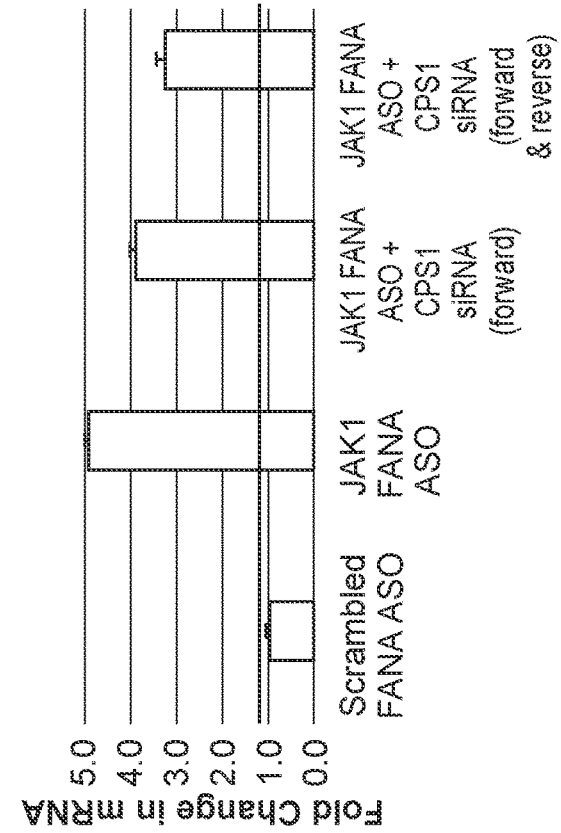
FIG. 24D shows OTC expression after treatment with JAK1 FANA, or both JAK1 FANA and CPS1 siRNA.
Figure 24A:
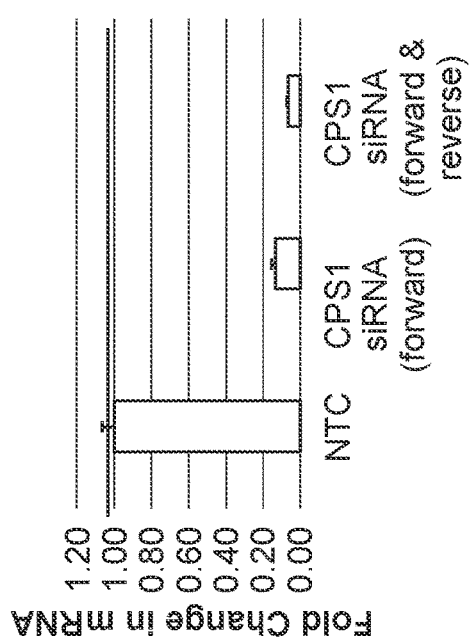
FIG. 24A shows CPS1 expression after treatment with CPS1 siRNA.

As shown in FIG. 24A, the CPS1 siRNA knock down was effective and significantly reduced CSP1 mRNA levels in both the forward only samples, and the forward and reverse transfection samples. Administration of the JAK1 FANA increased CPS1 mRNA, while the combination of JAK1 knockdown and CPS1 forward knockdown balanced each other (FIG. 24B, JAK1 FANA sample and JAK1 FANA+ CPS1 forward siRNA sample). The double knockdown of CPS1 using both forward and reverse transfection overcame the increase in CPS1 expression induced by the loss of JAK1 (FIG. 24B, JAK1 FANA+CPS1 forward and reverse siRNA sample).

Figure 24C:
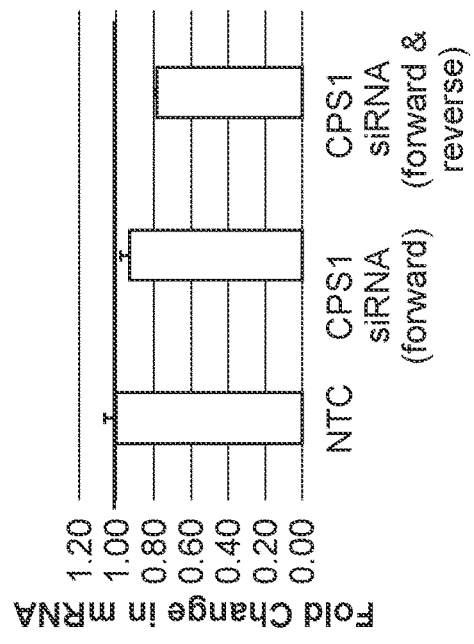
FIG. 24C shows OTC expression after treatment with CPS1 siRNA.
Figure 25A:
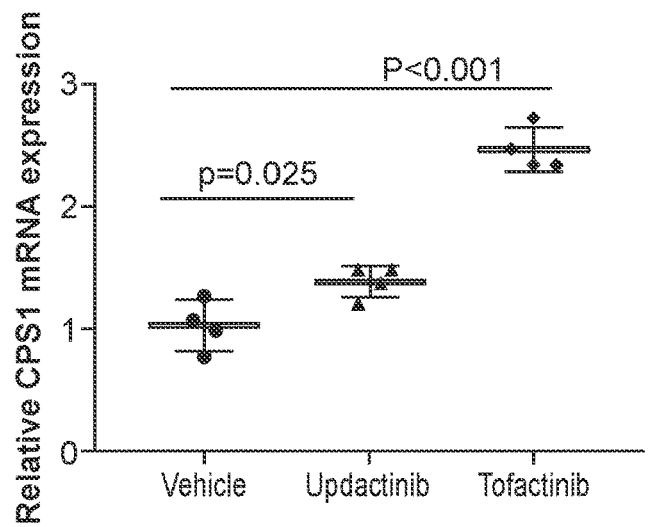
FIG. 25A shows an increase in CPS1 gene expression in vivo after treatment with the indicated JAK1 inhibitors.

The loss of CPS1 expression also affected OTC expression, as shown by the reduction in OTC expression after CPS1 siRNA treatment (FIG. 24C). And CPS1 knockdown by siRNA also affected OTC expression even when JAK1 was also knocked down. As seen in FIG. 25D, the inhibition of JAK1 by FANA increased OTC expression (FIG. 24D. JAK1 FANA sample). However, the loss of CPS1 expression also resulted in lower OTC expression, even in the absence of JAK1 expression (JAK1 FANA+CPS1 forward siRNA and JAK1 FANA+CPS1 forward and reverse siRNA samples). Thus, the mRNA expression level of CPS1 may play a role in modulating the expression level of OTC.

Example 13: JAK Inhibition Increases OTC and CPS1 Expression In Vivo 8-10 week old male C57/B16 mice were injected intraperitoneally with JAK1 inhibitors updactinib at 10 mg/kg or tofacitinib at 15 mg/kg. 8-10 week old male C57/B16 mice were injected intraperitoneally with JAK1 inhibitors updactinib at 10 mg/kg or tofacitinib at 15 mg/kg once daily for 4 days. After the final dose, the animals were sacrificed, their livers were harvested and snap-frozen. The livers were processed to extract total RNA and the mRNA for Otc and Cps1 were measured using qRT-PCR relative to the geometric mean of the expression levels of several housekeeping genes (Actb, B2m, Ppia, Gapdh, Hprt, Gusb).

Figure 25B:
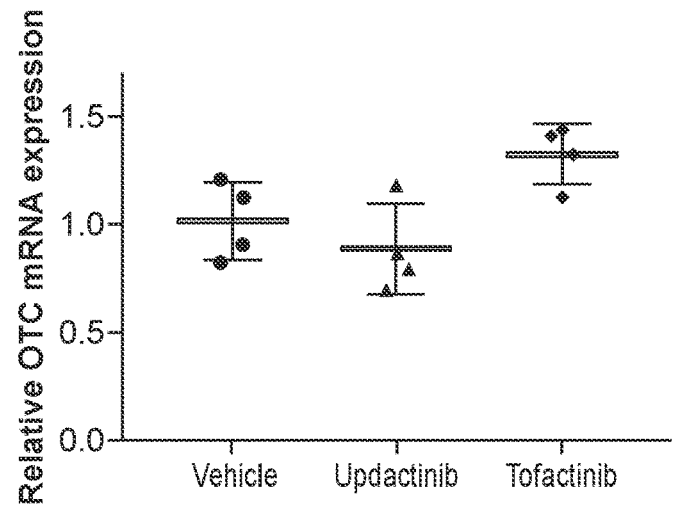
FIG. 25B shows an increase in OTC gene expression in vivo after treatment with tofacitinib.
Figure 25C:
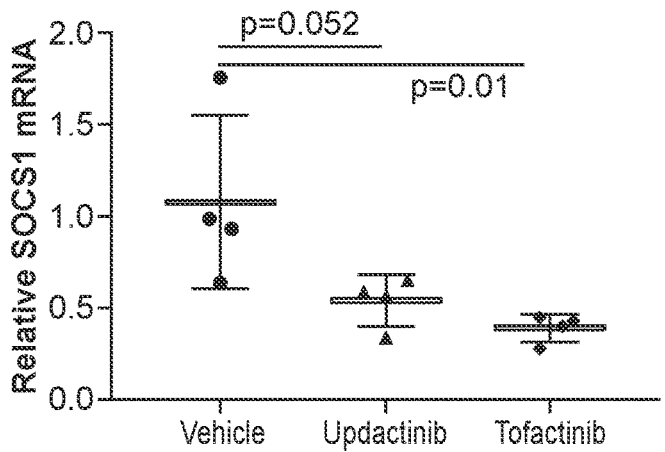
FIG. 25C shows a decrease in SOCS1 gene expression after treatment with the indicated JAK1 inhibitors.

Cps1 expression (FIG. 25A) and Otc expression (FIG. 25B) both increased in mice 6 hours after administration of updactinib or tofacitinib as compared to control treated mice. Therefore, administration of JAK1 inhibitors in vivo was effective in increasing Otc and Cps1 gene expression. In addition, Socs1 mRNA expression decreased (FIG. 25C). Socs1 is a known JAK target, thus inhibiting JAK1 resulted in a concomitant decrease in a downstream target gene.

Example 14: Transcription Factors that Regulate Both OTC and CPS1

Figure 26A:
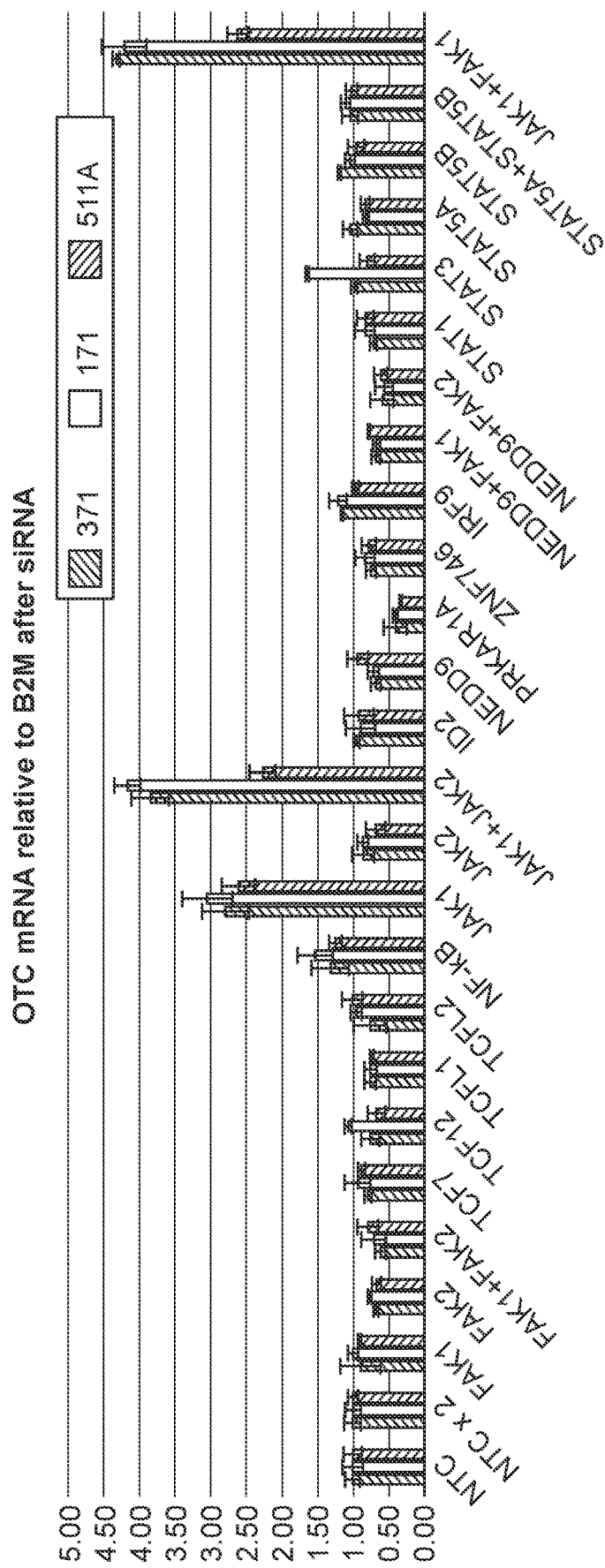
FIG. 26A shows that siRNA knockdown of JAK1 and JAK2 has an additive effect in increasing OTC expression, as compared to over JAK1 only siRNA knockdown.
Figure 26B:
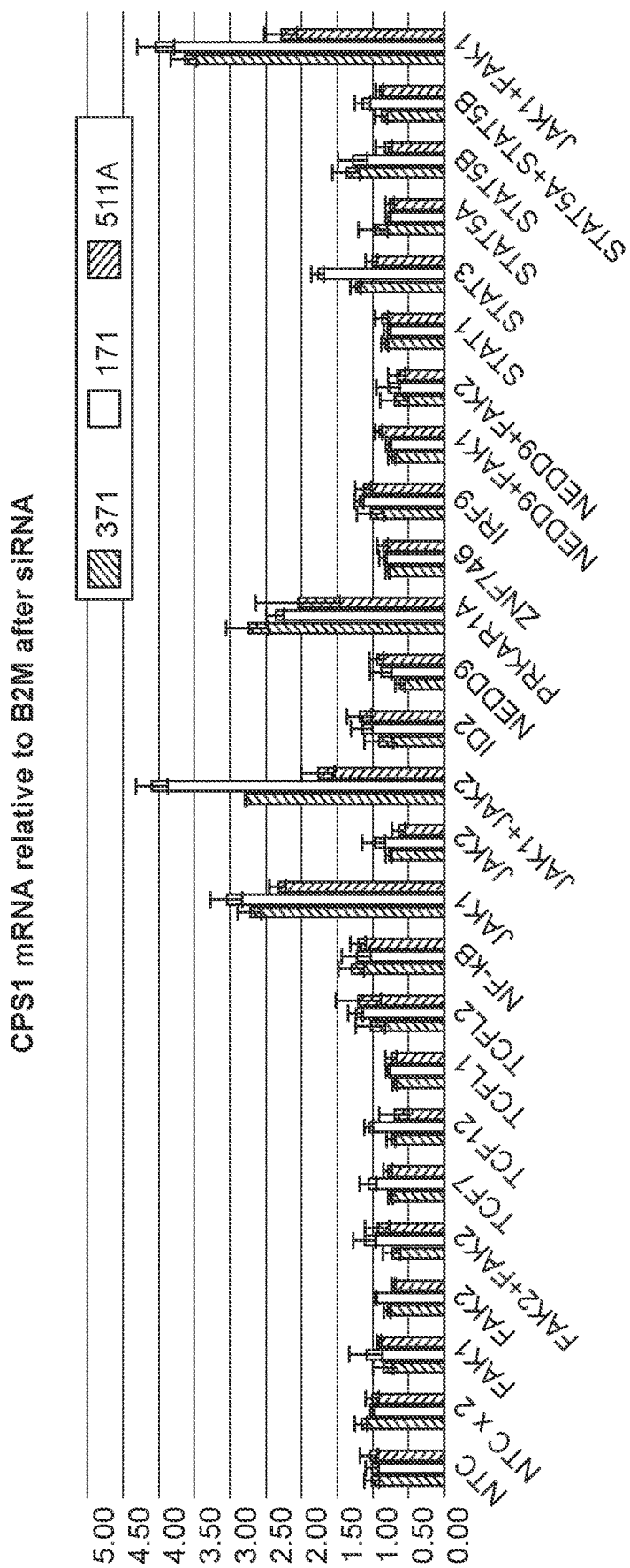
FIG. 26B shows that siRNA knockdown of JAK1 and JAK2 has an additive effect in increasing CPS1 expression, as compared to over JAK1 only siRNA knockdown.

To confirm the role of JAK1 and investigate the role of other signaling proteins and transcription factors in OTC and CPS1 expression, a panel of additional genes were knocked down with siRNA alone or in combination with JAK1. In particular, JAK2 was knockdown alone or in combination with JAK1. The combinations are shown in FIG. 26A and FIG. 26B. siRNA used to knock down JAK1 and JAK2 were: JAK1 siRNA Dharmacon #M-003145-02-0005; JAK2 siRNA Dharmacon #M-003146-02-0005. OTC and CPS1 mRNA expression was normalized to B2M. The assay was performed in triplicate in three donor hepatocyte cell lines: 371, 171, and 511A.

As shown in FIG. 26A (OTC mRNA) and FIG. 26B (CPS1 mRNA), JAK1 knock down resulted in the greatest increase in OTC or CPS1 mRNA expression. However, the addition of JAK1 and JAK2 knockdown resulted in an additive increase in OTC or CPS1 expression, as compared to JAK1 or JAK2 siRNA alone.

To assess the transcription factors that play a role in regulating both OTC and CPS1, hepatocytes were dual transfected with siRNA to knock down JAK1 and a selected transcription factor. Cells were transfected with 0.03 nM JAK1 siRNA, resulting in about a 50% decrease in JAK1 expression, and 10 nM siRNA targeting a selected transcription factor. Transcription factors and siRNA used were: JAK1 siRNA Dharmacon #M-003145-02-0005; JAK2 siRNA Dharmacon #M-003146-02-0005; JAK3 siRNA Dharmacon #M-020858-02-0005; TYK2 siRNA Dharmacon #M-003182-02-0005; STAT1 siRNA Dharmacon #M-003543-01-0005; STAT2 siRNA Dharmacon #M-012064-00-0005; STAT3 siRNA Dharmacon #M-003544-02-0005; STAT4 siRNA Dharmacon #M-011784-01-0005; STAT5B siRNA Dharmacon #M-010539-02-0005; STAT5A siRNA Dharmacon #M-005169-02-0005; IRF1 siRNA Dharmacon #M-011704-01-0005; IRF2 siRNA Dharmacon #M-011705-01-0005; IRF7 siRNA Dharmacon #M-011810-02-0005; IRF8 siRNA Dharmacon #M-011699-01-0005; IRF9 siRNA Dharmacon #M-020858-02-0005.

Cells were harvested after siRNA treatment for mRNA quantification. JAK1, OTC, and CPS1 mRNA levels were normalized to GUSB.

Figures 27A, 27B:
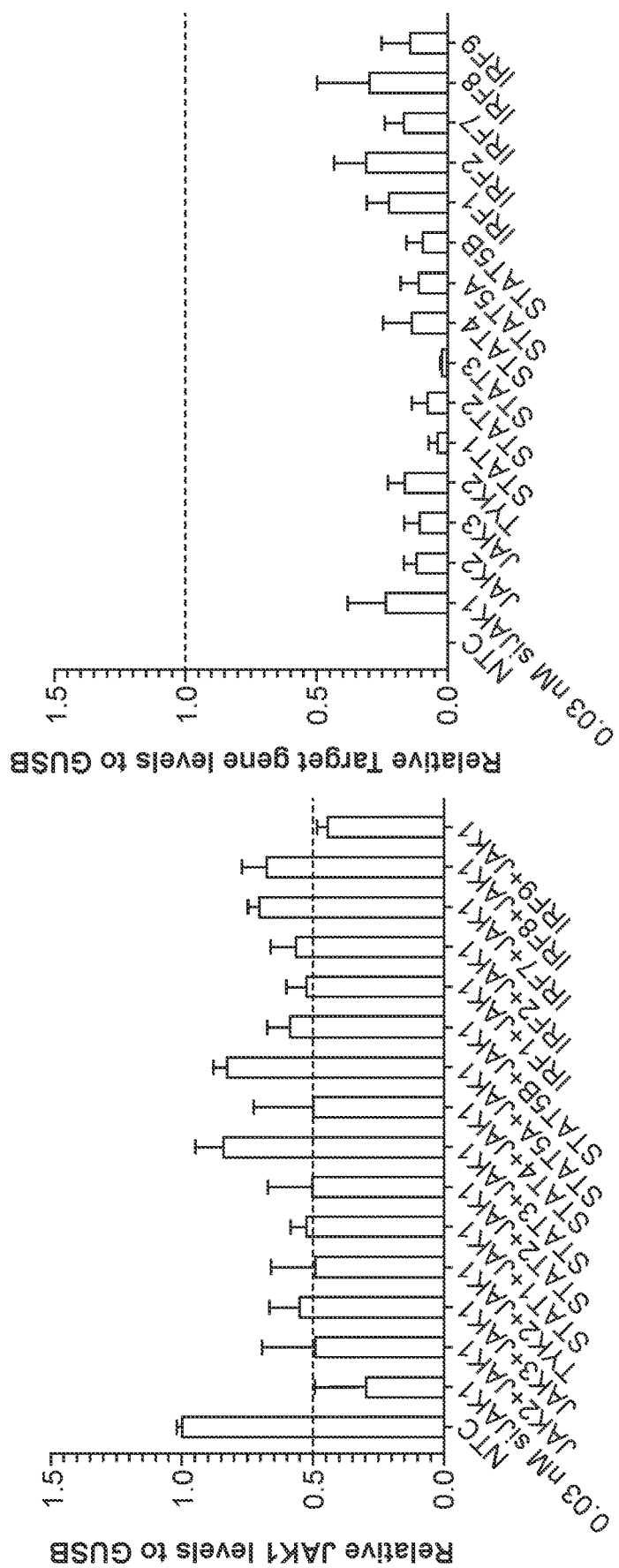
FIG. 27A shows JAK1 expression after knockdown of the indicated target genes with siRNA.
FIG. 27B shows the target gene expression after treatment with siRNA.
Figure 27C:
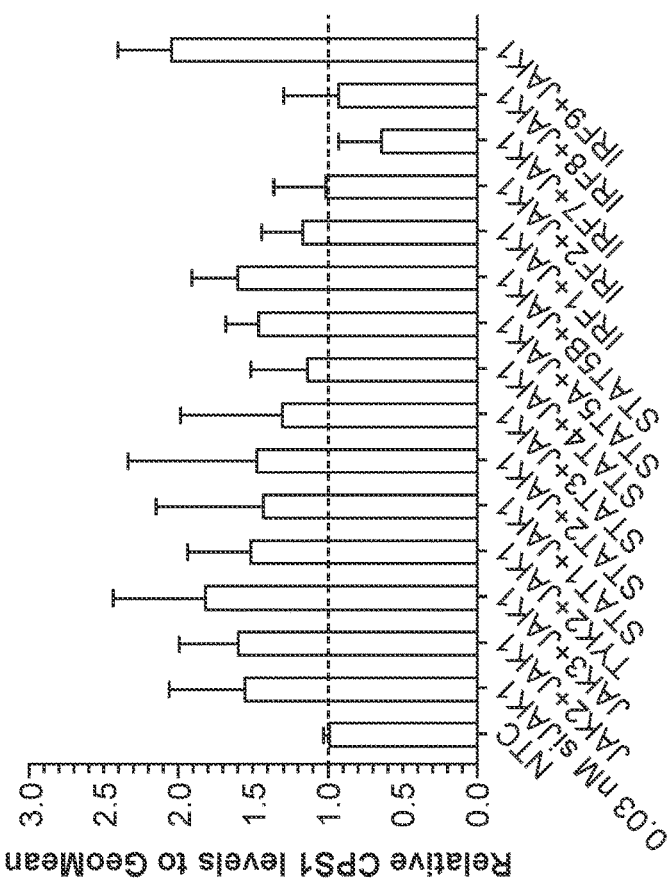
FIG. 27C shows OTC expression after knockdown of the indicated target genes with siRNA.
Figure 27D:
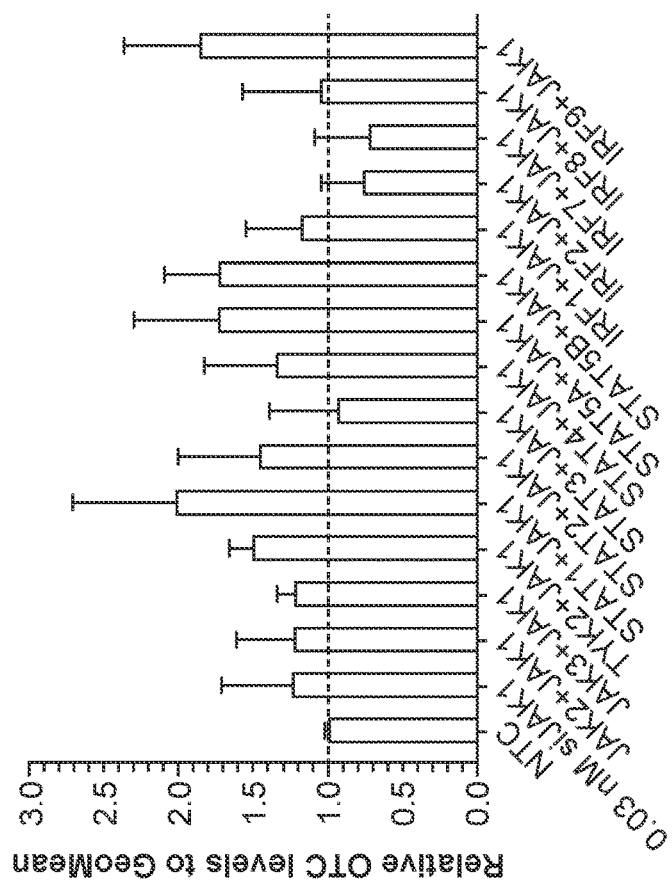
FIG. 27D shows CPS1 expression after knockdown of the indicated target genes with siRNA.

FIG. 27A shows JAK1 relative mRNA levels after siRNA treatment. JAK1 was reduced approximately 50% after siRNA treatment in most conditions. FIG. 27B shows the relative mRNA levels of the target non-JAK1 signaling proteins or transcription factors after siRNA treatment, e.g., JAK2, JAK3, TYK2, STAT1, STAT2, STAT3, STAT4, STAT5B, STAT5A, IRF1, IRF2, IRF7, IRF8, or IRF9 mRNA levels. Target gene expression was reduced approximately 89-90% after siRNA treatment in most conditions. FIG. 27C shows the relative mRNA levels of OTC expression after knockdown of the indicated target proteins. FIG. 27D shows the relative mRNA levels of CPS1 expression after knockdown of the indicated target proteins.

As shown in FIG. 27C and FIG. 27D, knockdown of STAT1, STAT5A, STAT5B, or IRF9 in combination with JAK1 increased OTC expression, while inhibition of both IRF9 and JAK1 increased CPS1 expression. Thus, knockdown of both IRF9 and JAK1 increased OTC and CPS1 expression simultaneously.

Example 15: HSP90 Inhibition Increases OTC and CPS1 Expression In Vitro

Additional small molecules that inhibit HSP90 or HSP70 were tested in primary human hepatocytes as described in Example 2. The inhibitors and their CAS registry numbers are shown in Table 31. HSP90 or HSP70 inhibitors were tested in triplicate at 0.3 µM and 3 µM. The results are shown as the fold change (mRNA FC) in the mRNA levels of OTC and CPS1 genes after treatment compared to an untreated control (DMSO) and the standard deviation (SD). In addition, a dose titration experiment was performed with selected HSP90 inhibitors. Hepatocytes were incubated with increasing concentrations of HSP90 inhibitors and the changes in OTC and CPS1 expression quantified as previously described.

TABLE 31

HSP90 and HSP70 Inhibitors

| Compound Name | CAS Number | Target |
|---|---|---|
| BIIB021 | 848695-25-0 | HSP90 |
| HSP-990 | 934343-74-5 | HSP90 |
| Retaspimycin Hydrochloride (HCl) | 857402-23-4 | HSP90 |

TABLE 31-continued

HSP90 and HSP70 Inhibitors

| Compound Name | CAS Number | Target |
|---|---|---|
| PF-04929113 | 908115-27-5 | HSP90 |
| Luminespib | 747412-49-3 | HSP90 |
| 17-AAG | 467214-21-7 | HSP90 |
| Alvespimycin | 467214-20-6 | HSP90 |
| Alvespimycin hydrochloride (HCl) | 467214-21-7 | HSP90 |
| Pifithrin-µ | 64984-31-2 | HSP70 |
| EC144 | 911397-80-3 | HSP90 |

Hepatocytes from two different donors (A and B) were incubated with the various concentrations of HSP90 inhibitors for 18 hours and harvested for mRNA analysis. OTC and CPS1 mRNA were normalized to house keeping gene B2M gene expression.

Figures 28A, 28B:
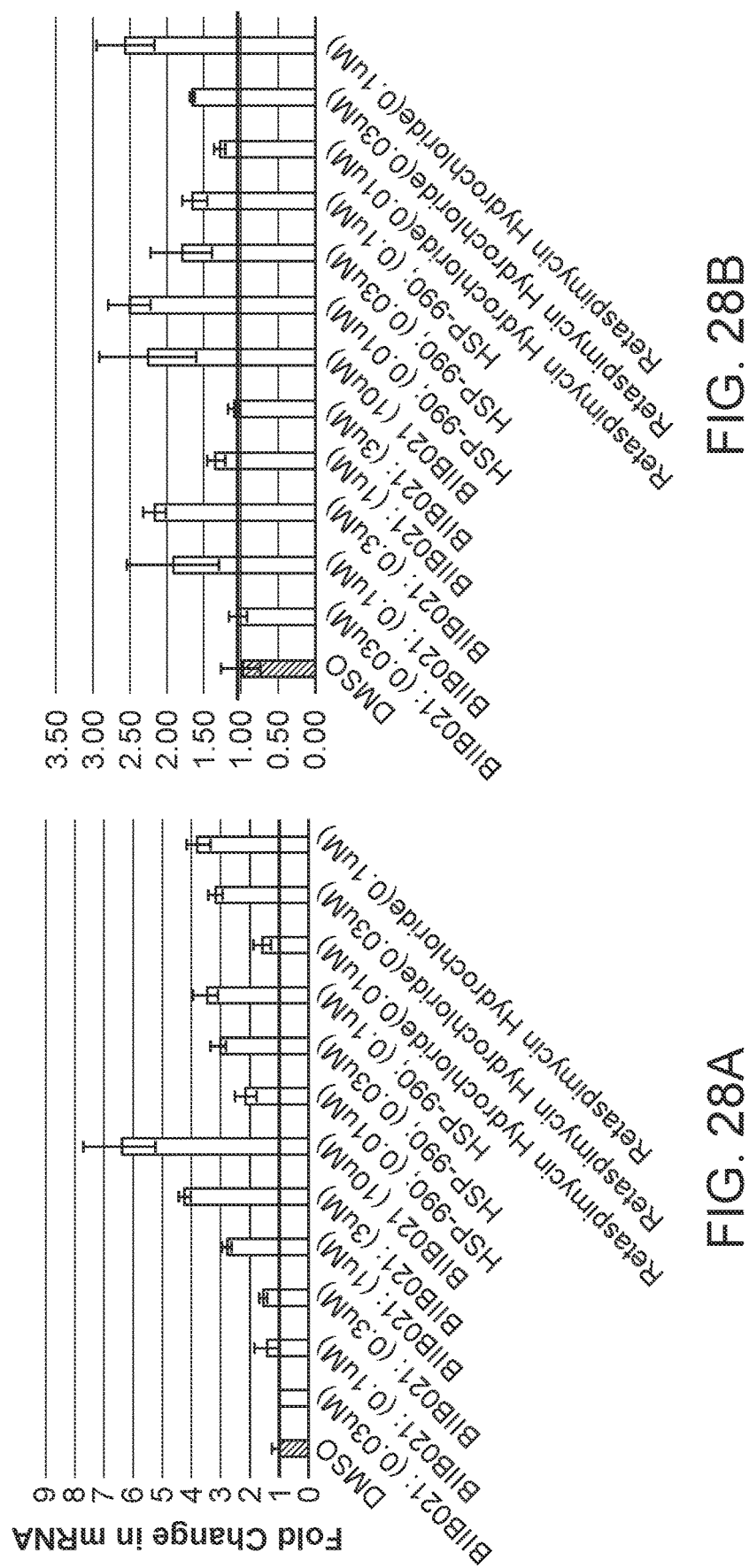
FIG. 28A shows CPS1 gene expression in Donor A cell line after treatment with the indicated compounds.
FIG. 28B shows CPS1 gene expression in Donor B cell line after treatment with the indicated compounds.
Figure 28C:
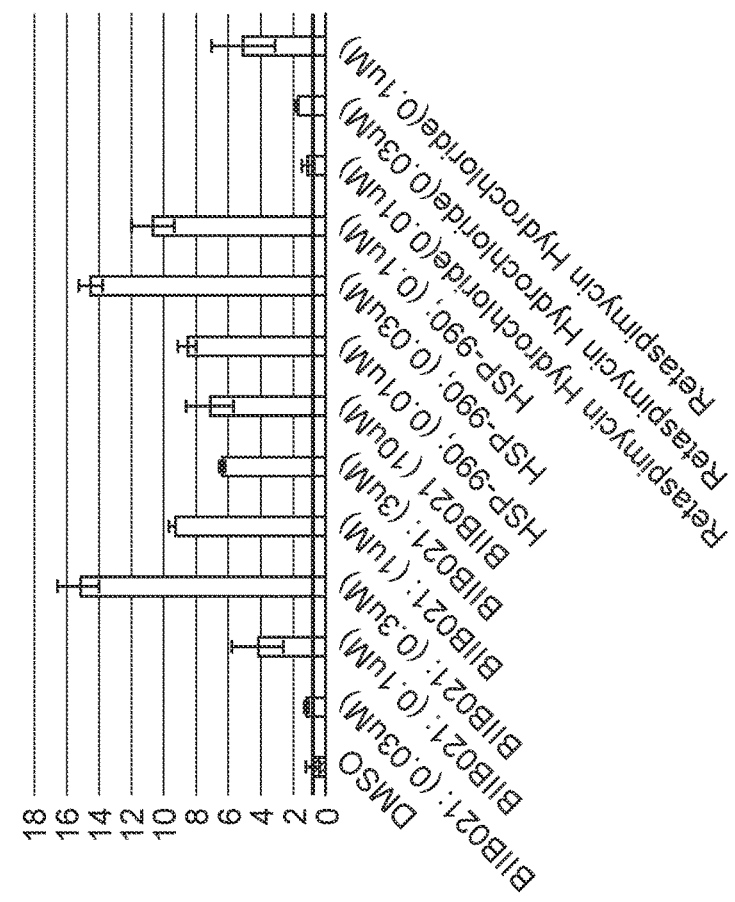
FIG. 28C shows OTC gene expression in Donor A cell line after treatment with the indicated compounds.
Figure 28D:
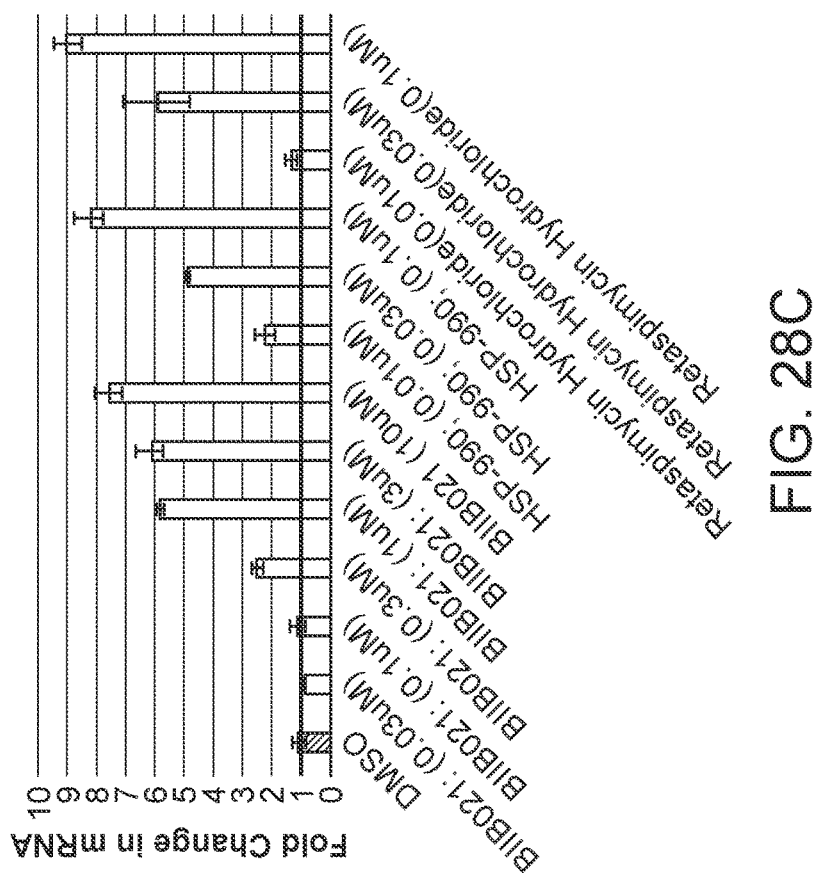
FIG. 28D shows OTC gene expression in Donor B cell line after treatment with the indicated compounds.

All HSP90 inhibitors showed a dose dependent increase in CPS1 or OTC mRNA expression in both donor cell lines. FIG. 28A shows CPS1 gene expression in Donor A, FIG. 28B shows CPS1 gene expression in Donor B, FIG. 28C shows OTC gene expression in Donor A, FIG. 28D shows OTC gene expression in Donor B. DMSO was used as a control. Table 32 shows the CPS1 and OTC mRNA fold change and standard deviation (SD) in each donor cell line.

TABLE 32

| Treatment | mRNA FC | SD | mRNA FC | SD |
|---|---|---|---|---|
| | CPS1 mRNA, Donor A | | CPS1 mRNA, Donor B | |
| DMSO | 1.02 | 0.21 | 1.02 | 0.25 |
| BIIB021; (0.03 uM) | 0.98 | 0.09 | 1.05 | 0.11 |
| BIIB021; (0.1 uM) | 1.40 | 0.40 | 1.93 | 0.61 |
| BIIB021; (0.3 uM) | 1.54 | 0.13 | 1.95 | 0.39 |
| BIIB021; (1 uM) | 2.75 | 0.15 | 1.37 | 0.16 |
| BIIB021; (3 uM) | 4.27 | 0.11 | 1.13 | 0.07 |
| BIIB021; (10 uM) | 6.41 | 1.32 | 1.83 | 0.88 |
| HSP-990; (0.01 uM) | 2.15 | 0.36 | 2.52 | 0.28 |
| HSP-990; (0.03 uM) | 3.07 | 0.26 | 1.82 | 0.40 |
| HSP-990; (0.1 uM) | 3.50 | 0.44 | 2.12 | 0.78 |
| Retaspimycin (0.01 uM) Hydrochloride | 1.54 | 0.33 | 1.29 | 0.08 |
| Retaspimycin (0.03 uM) Hydrochloride | 3.17 | 0.25 | 1.67 | 0.03 |
| Retaspimycin (0.1 uM) Hydrochloride | 3.76 | 0.42 | 2.57 | 0.38 |
| | OTC mRNA, Donor A | | OTC mRNA, Donor B | |
| DMSO | 1.02 | 0.21 | 1.01 | 0.15 |
| BIIB021; (0.03 uM) | 0.84 | 0.02 | 1.24 | 0.14 |
| BIIB021; (0.1 uM) | 1.13 | 0.19 | 4.23 | 1.63 |
| BIIB021; (0.3 uM) | 2.46 | 0.15 | 15.30 | 1.31 |
| BIIB021; (1 uM) | 5.86 | 0.00 | 9.49 | 0.23 |
| BIIB021; (3 uM) | 6.12 | 0.48 | 6.59 | 0.15 |
| BIIB021; (10 uM) | 7.61 | 0.49 | 7.17 | 1.50 |
| HSP-990; (0.01 uM) | 2.24 | 0.27 | 8.62 | 0.51 |
| HSP-990; (0.03 uM) | 4.84 | 0.01 | 14.59 | 0.65 |
| HSP-990; (0.1 uM) | 8.24 | 0.44 | 10.72 | 1.30 |
| Retaspimycin (0.01 uM) Hydrochloride | 1.40 | 0.13 | 1.31 | 0.23 |
| Retaspimycin (0.03 uM) Hydrochloride | 5.91 | 1.21 | 1.78 | 0.09 |
| Retaspimycin (0.1 uM) Hydrochloride | 9.07 | 0.28 | 5.18 | 1.88 |

Figure 29A:
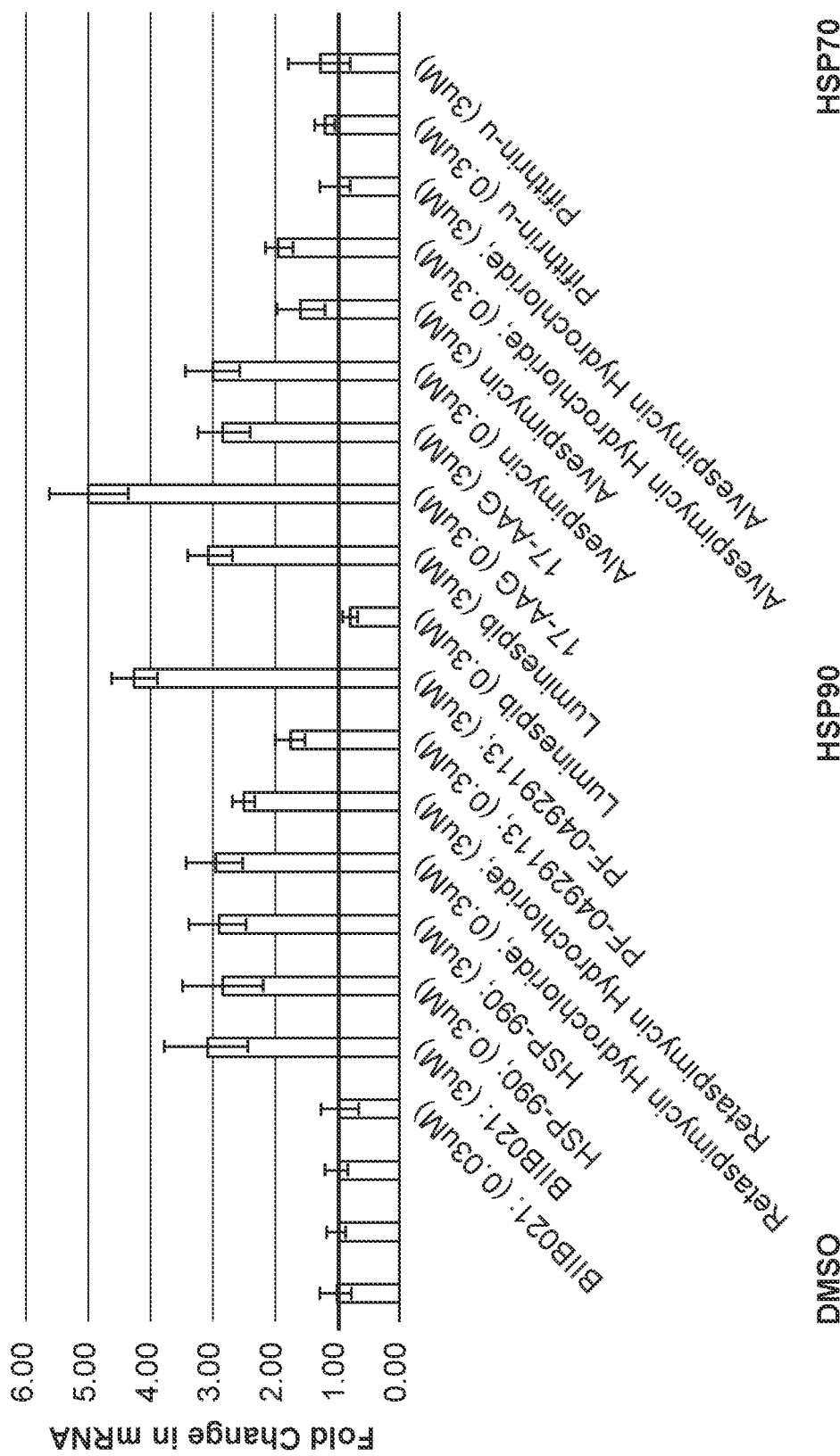
FIG. 29A shows HPS90 inhibitors, but not HP70 inhibitors, increase OTC expression.
Figure 29B:
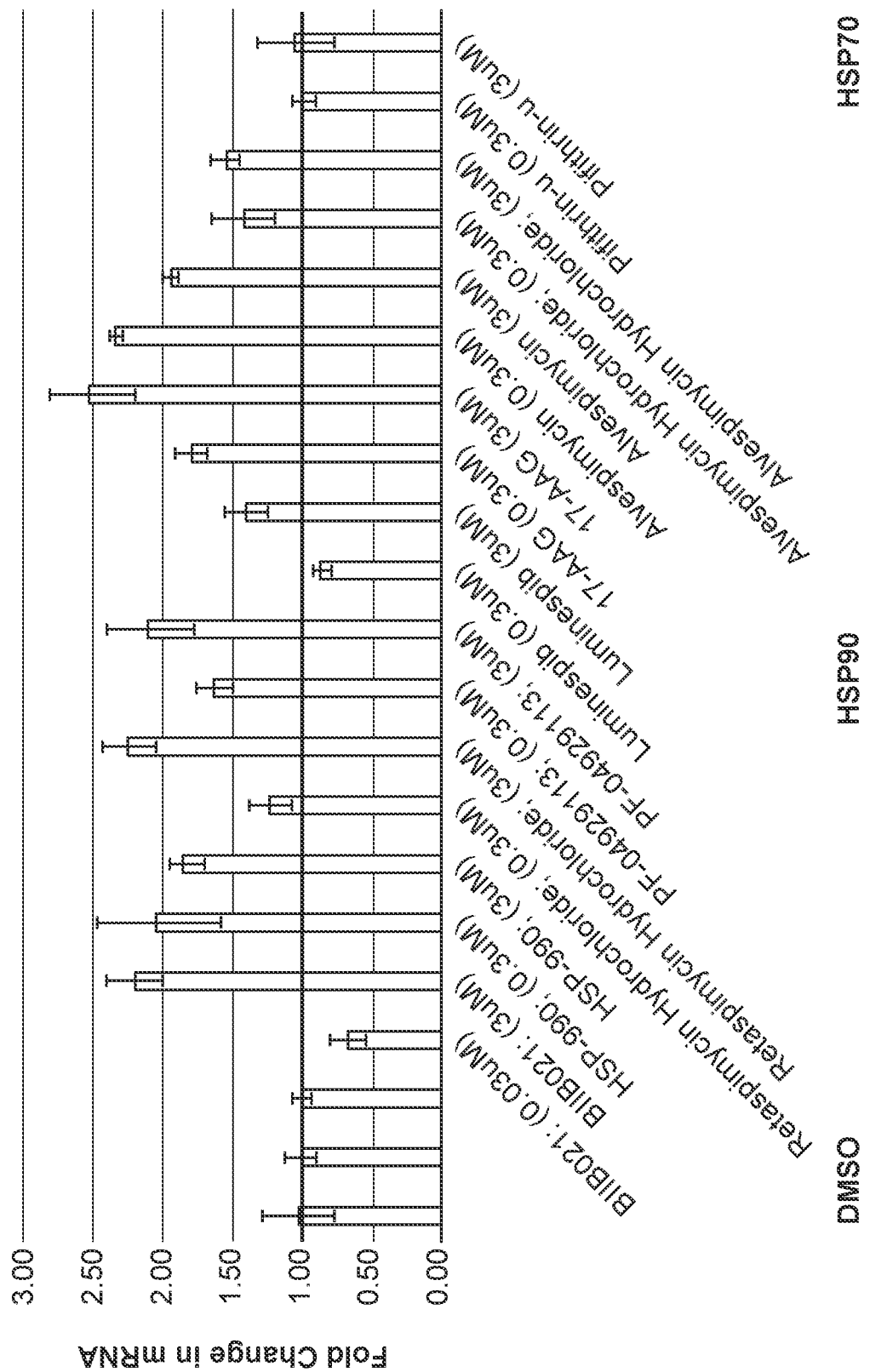
FIG. 29B shows HPS90 inhibitors, but not HP70 inhibitors, increase CPS1 expression.

HSP90 and HSP70 inhibitors were compared to confirm the role of HSP90 in modulating OTC and CPS1 expression. Hepatocytes from Donor B were incubated with various HSP90 inhibitors or an HSP70 inhibitor, Pifithrin-μ, and then harvested for mRNA quantification. OTC and CPS1 mRNA levels were normalized to B2M. FIG. 29A shows OTC gene expression after administration of HSP90 and HPS70 inhibitors. FIG. 29B shows CPS1 gene expression after administration of HSP90 and HPS70 inhibitors. Relative mRNA levels of both are shown in Table 33. HSP90 inhibition, but not HSP70 inhibition, robustly increased OTC and CPS1 mRNA expression.

tification in Hep3B cells. Therefore, inhibition of HSP90 inhibitor increased both urea cycle genes and the production of urea in vitro.

Example 17: HSP90 Inhibitor EC144 is Effective In Vivo

The in vivo effect of EC144 was assessed. EC144 is an HSP90 inhibitor with CAS Registry No. 911397-80-3. 8-10 week old male C57/B16 mice were injected intraperitoneally with EC144 at 5 mg/kg once daily for 4 days. After the final dose, the animals were sacrificed at 5 h, 7 h or 9 h post-dose

TABLE 33

| Pathway | Treatment | OTC Expression | | CPS1 Expression | |
|---|---|---|---|---|---|
| | | mRNA FC | SD | mRNA FC | SD |
| | DMSO | 1.03 | 0.25 | 1.03 | 0.25 |
| | DMSO | 1.01 | 0.15 | 1.01 | 0.11 |
| | DMSO | 1.01 | 0.17 | 1.00 | 0.07 |
| HSP90 | BIIB021; (0.3 uM) | 0.95 | 0.30 | 0.67 | 0.13 |
| | BIIB021; (3 uM) | 3.12 | 0.67 | 2.18 | 0.21 |
| | HSP-990; (0.3 uM) | 2.85 | 0.66 | 2.03 | 0.42 |
| | HSP-990; (3 uM) | 2.93 | 0.45 | 1.84 | 0.11 |
| | Retaspimycin (0.3 uM) Hydrochloride | 2.98 | 0.47 | 1.23 | 0.15 |
| | Retaspimycin (3 uM) Hydrochloride | 2.53 | 0.16 | 2.24 | 0.18 |
| | PF-04929113 (0.3 uM) | 1.77 | 0.24 | 1.62 | 0.13 |
| | PF-04929113 (3 uM) | 4.28 | 0.37 | 2.09 | 0.31 |
| | Luminespib (0.3 uM) | 0.81 | 0.12 | 0.86 | 0.08 |
| | Luminespib (3 uM) | 3.07 | 0.37 | 1.39 | 0.14 |
| | 17-AAG (0.3 uM) | 5.01 | 0.64 | 1.79 | 0.12 |
| | 17-AAG (3 uM) | 2.84 | 0.42 | 2.51 | 0.31 |
| | Alvespimycin (0.3 uM) | 3.03 | 0.43 | 2.33 | 0.05 |
| | Alvespimycin (3 uM) | 1.57 | 0.39 | 1.94 | 0.05 |
| | Alvespimycin (0.3 uM) hydrochloride | 1.94 | 0.22 | 1.41 | 0.21 |
| | Alvespimycin (3 uM) hydrochloride | 1.03 | 0.25 | 1.54 | 0.10 |
| HSP70 | Pifithrin-μ (0.3 uM) | 1.20 | 0.16 | 0.98 | 0.08 |
| | Pifithrin-μ (3 uM) | 1.29 | 0.49 | 1.05 | 0.27 |

Figure 30:
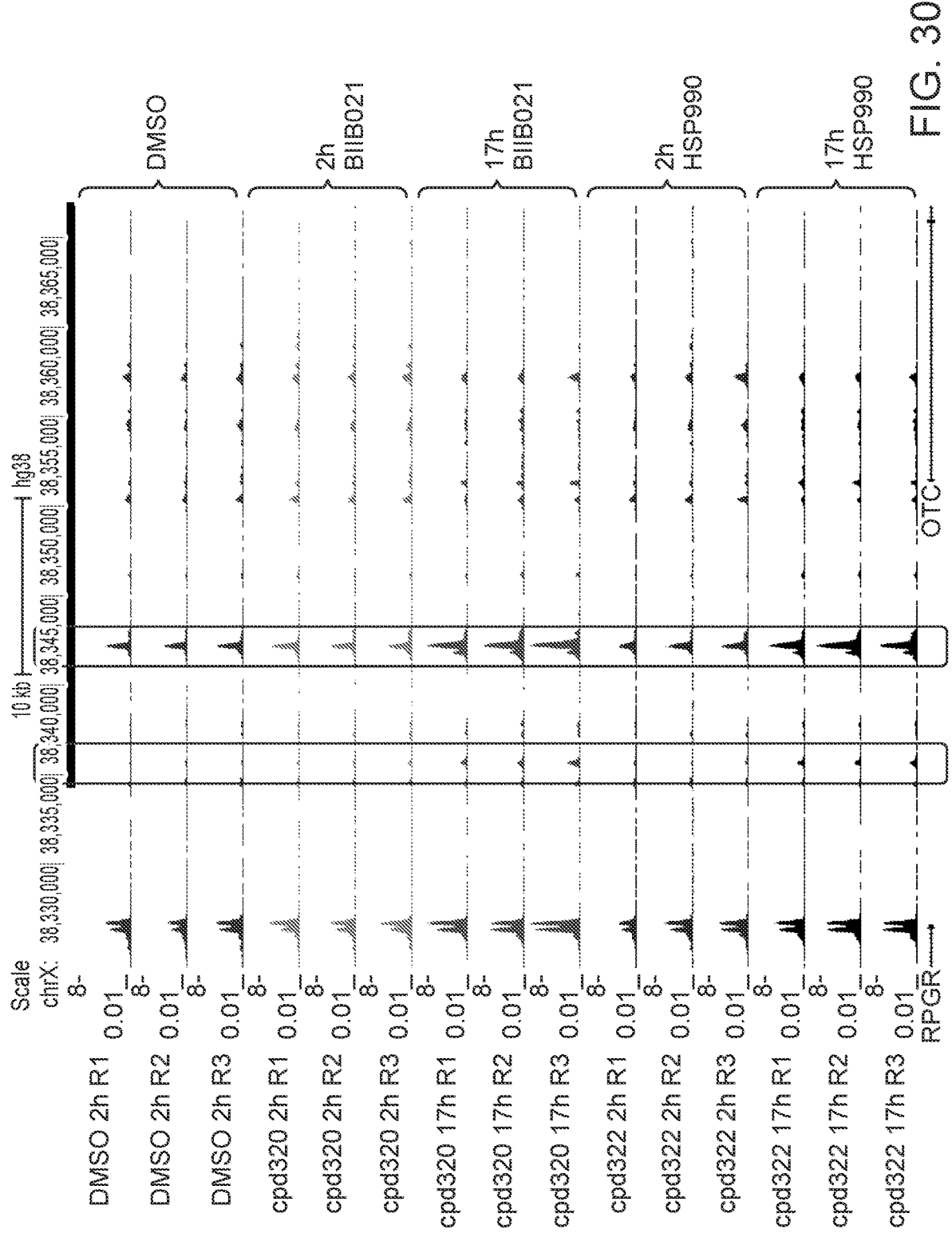
FIG. 30 shows opening of a novel chromatin domain and increased accessibility of an open chromatin domain upstream of the OTC gene after treatment with the indicated HSP90 inhibitors.

The changes in the chromatin structure of the OTC insulated neighborhood after administration of HSP90 inhibitors were also assessed via ATAC-seq as described in Example 1. The ATAC-seq experiment was done in triplicate. As shown in FIG. 30, cells incubated with BIIB021 or HSP990 showed a newly accessible chromatin domain upstream of the OTC gene after 17 hours of inhibitor treatment (left circle) as evidenced be the new chromatin peak, and an increase in accessibility of previously available chromatin (right circle), as evidenced by the shoulder and increase in peak size of the existing chromatin peak.

Example 16: HSP90 Inhibition Increases Ureagenesis

Hep3B cells were plated and treated with increasing concentrations of HSP90 inhibitor BIIB021 (0.03 μM to 3 The spent media from the culture was collected and the urea levels in the media measured using the Blood Urea Nitrogen Assay Kit (Invitrogen, Cat #EIABUN) per manufacturer's instructions.

Figure 31A:
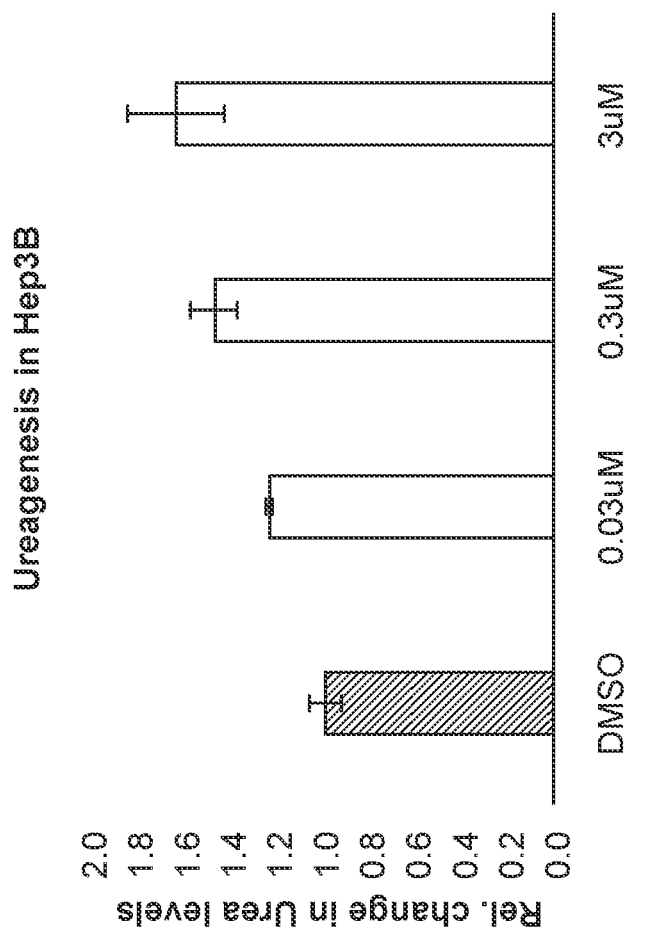
FIG. 31A shows HSP90 inhibitor BIIB021 increases ureagenesis in hepatocytes.
Figure 31B:
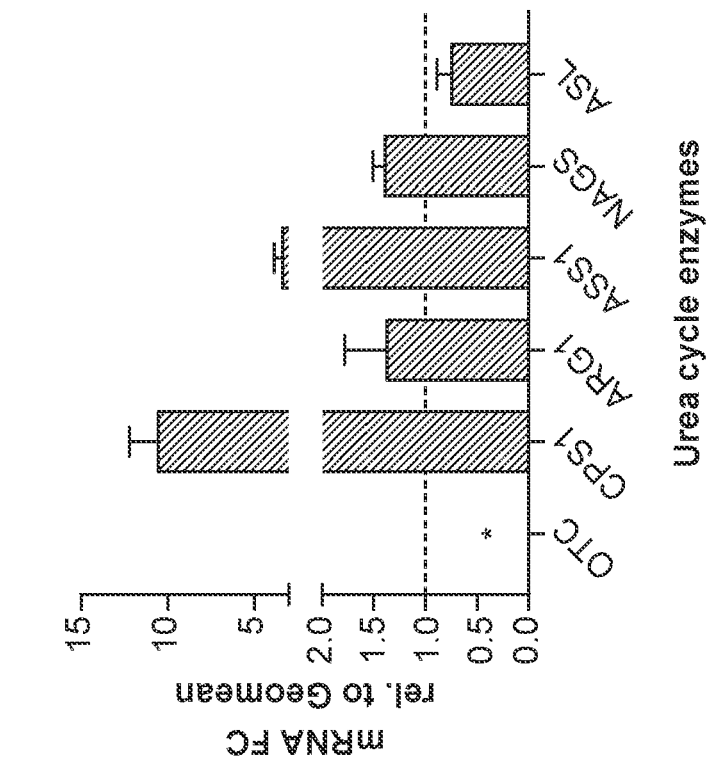
FIG. 31B shows HSP90 inhibitor BIIB021 increases expression of multiple urea cycle genes.

As shown in FIG. 31A, there was a dose-dependent increase in urea production in Hep3B cells after administration of the HSP90 inhibitor BIIB021. Increases in the urea cycle genes CPS1, ARG1, ASS1, and NAGS were also observed (FIG. 31B). OTC mRNA levels were not able to be determined due to a technical problem of OTC gene quanand their livers and serum collected and flash frozen. The livers were processed and total RNA extracted. mRNA levels for Otc, Cps1, Ass1, As1, Arg1 and Nags were measured using qRT-PCR relative to the geometric mean of the expression levels of several housekeeping genes (Actb, B2m, Ppia, Gapdh, Hprt, Gusb).

Serum urea levels were measured using the Blood Urea Nitrogen Assay Kit (Invitrogen, Cat #EIABUN) per manufacturer's instructions. The data was plotted in GraphPad and statistical significance of the data sets determined using the Holm-Sidak method for multiple comparisons ($\alpha=0.05$).

Figure 32:
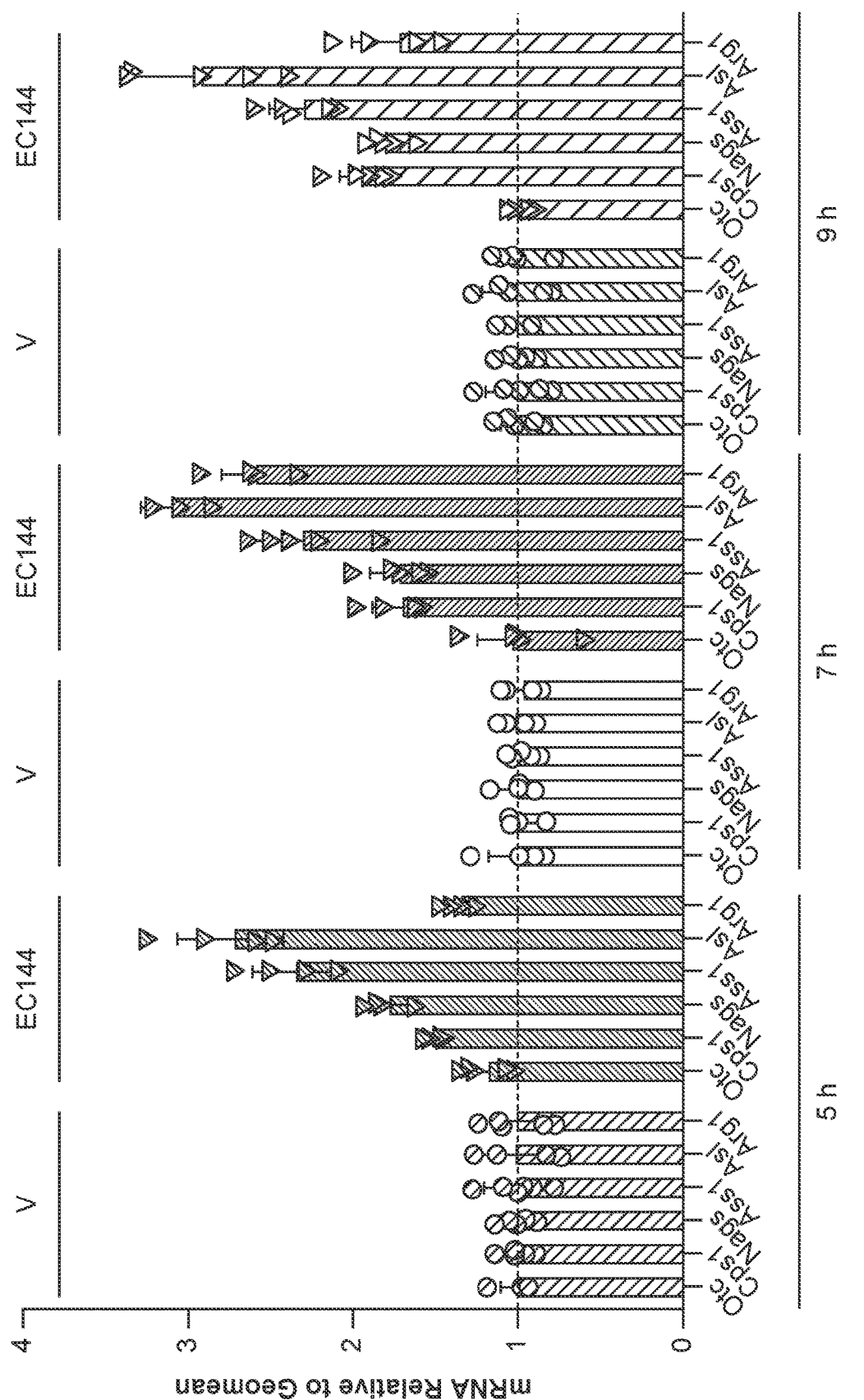
FIG. 32 shows in vivo gene expression of the indicated urea cycle genes after treatment with EC144 or control vehicle (V) at various time points post administration.

As shown in FIG. 32, treatment with EC144 increased expression of the urea cycle genes Otc, Cps1, Nags, Ass1, As1, and Arg1 in vivo.

Otc expression was increased in vivo 5 h after administration of EC144 (FIG. 33A), while Cps1 expression was increased in vivo at 5 h, 7 h, and 9 h after administration of EC144 (FIG. 33B). Cps1 expression also increased over time, with greater expression at 9 h after administration as compared to 5 h.

The serum urea levels in the mice increased after administration of EC144, indicating an increase in ureagenesis induced by the HSP90 inhibitor (FIG. 33C). Urea levels at each time point were statistically significant as compared to mice treated with vehicle alone. Therefore, HSP90 inhibitors were effective in vitro and in vivo in increasing expression of the urea cycle genes and in increase ureagenesis.

EQUIVALENTS AND SCOPE

Those skilled in the art will recognize, or be able to ascertain using no more than routine experimentation, many equivalents to the specific embodiments in accordance with the methods described herein. The scope provided herein is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment provided herein that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

TABLE 34

Motifs for Binding Sites or Signaling Centers

| Motif Sequence | SEQ ID NO | Gene symbol | Motif Sequence | SEQ ID NO | Gene symbol |
|---|---|---|---|---|---|
| AAAAGTCAA | | NR2E1 | NAACCGGTTN | 371 | TFCP2 |
| AAAATGGCGCCATTTT | 39 | E2F2 | NACACGTGTN | 372 | CLOCK |
| AAACCACAAA | 40 | RUNX1 | NACCCGGAAGTAN | 373 | ELF3 |
| AAAGTAAACA | 41 | FOXA1 | NACCGAAACYN | 374 | IRF5 |
| AAATGGCGCCATTT | 42 | E2F1 | NACGCCCACGCANN | 375 | EGR1 |
| AACAGCTGTT | 43 | MSC | NAGGTGTGAAAWN | 376 | EOMES |
| AACATCTGGA | 44 | ZBTB18 | NAGGTGTGAAN | 377 | TBR1 |
| AACCGGAAGT | 45 | ELF1 | NAGGTGTGAAN | 378 | TBX20 |
| AACCGGAAGT | 46 | ETV1 | NAGGTGTGAWN | 379 | TBX2 |
| AACCGGAAGT | 47 | GABPA | NATATGCTAATKN | 380 | POU5F1 |
| AATGGCGCCAAA | 48 | E2F1 | NATGACGTCAYN | 381 | JDP2 |
| AATGGCGCCAAA | 49 | E2F4 | NATGCGGAAGTR | 382 | ELF2 |
| AATTGGCCAATTA | 50 | LBX2 | NATGCGGGTAN | 383 | GCM1 |
| ACAGGAAGTG | 51 | ERG | NATGCGGGTN | 384 | GCM2 |
| ACAGGAAGTG | 52 | ETS1 | NCCGCCATTNN | 385 | YY1 |
| ACATCCTGGT | 53 | SPDEF | NCCGTTAACGGN | 386 | MYBL1 |
| ACCCTTGAACCC | 54 | ZNF524 | NCGAAACCGAAACY | 387 | IRF8 |
| ACCGAACAAT | 55 | SOX17 | NCGAAACCGAAACYN | 388 | IRF4 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| aCGCGTc | | MBL2 | NCGACCACCGAN | 389 | ZBTB7B |
| ACTACAATTCCC | 56 | GFY | NCTAATTANN | 390 | LHX2 |
| ACTGAAACCA | 57 | IRF4 | NCTCGTAAAAN | 391 | HOXA13 |
| ACTTTCACTTTC | 58 | PRDM1 | NCTCGTAAAAN | 392 | HOXB13 |
| AGAAATGACTTCCCT | 59 | ZNF528 | NCTCGTAAAAN | 393 | HOXC13 |
| AGAGGAAGTG | 60 | MAZ | NCTCGTAAAAN | 394 | HOXD13 |
| aGATAAG | | SLC6A1 | NGATGACGTCATCR | 395 | FOS |
| AGGCCTAG | | ZNF711 | NGCGACCACCNN | 396 | ZBTB7A |
| AGGCCTGG | | ZFX | NGGCACGTGCCN | 397 | HES5 |
| AGGTCTCTAACC | 61 | PRDM14 | NGGCACGTGCCN | 398 | HES7 |
| AGGTGTGA | | MGAM | NGTCGTAAAAN | 399 | HOXC12 |
| AGGTGTGA | | TBX1 | NGTCGTAAAAN | 400 | HOXD12 |
| AGGTGTGA | | TBX15 | NKCACGTGMN | 401 | BHLHE40 |
| AGGTGTGA | | TBX4 | NKCACGTGMN | 402 | BHLHE41 |
| AGGTGTGA | | TBX5 | NNAAATGGCGCCAAAANN | 403 | E2F3 |
| AGGTGTGAAAAAGGTGTGA | 62 | TBX1 | NNAAATGGCGCCATTTNN | 404 | E2F3 |
| AGGTGTGAAGGTGTGA | 63 | TBX20 | NNAACCGTTNN | 405 | MYBL1 |
| ATaacATG | | SLC6A11 | NNAACCGTTNN | 406 | MYBL2 |
| ATAGTGCCACCTGGTGGCCA | 64 | CTCF | NNACGCCCACGCANN | 407 | EGR3 |
| ATCAATAACATTGAT | 65 | SOX15 | NNACGCCCACGCANNN | 408 | EGR4 |
| ATCAATTGCAGTGAT | 66 | SOX10 | NNATGACGTCATNN | 409 | ATF7 |
| ATCACGTGAT | 67 | MLX | NNCACCTGCN | 410 | TCF3 |
| ATCACGTGAT | 68 | MLXIPL | NNCACCTGNN | 411 | FIGLA |
| ATGAATAACATTCAT | 69 | SOX15 | NNCACCTGNN | 412 | MESP1 |
| ATGAATTGCAGTCAT | 70 | SOX10 | NNCACCTGNN | 413 | TCF3 |
| ATGACGTCAT | 71 | JUN | NNCACCTGNN | 414 | TCF4 |
| ATGACTCAT | | BACH1 | NNCACGTGNN | 415 | HEY1 |
| ATGACTCATC | 72 | FOS | NNCACGTGNN | 416 | MAX |
| ATGCCCTGAGGC | 73 | TFAP2A | NNCACGTGNN | 417 | MNT |
| ATTGCGCAAC | 74 | CEBPA | NNCACGTGNN | 418 | TFE3 |
| CAAGATGGCGGC | 75 | YY1 | NNCATATGNN | 419 | BHLHA15 |
| CACCGAACAAT | 76 | SOX6 | NNCATATGNN | 420 | NEUROD2 |
| CCAAT | | NFYA | NNCCGCCATNW | 421 | YY2 |
| CCAAT | | NFYB | NNGCAACAGGTGGNN | 422 | SCRT1 |
| CCAAT | | NFYC | NNGCAACAGGTGN | 423 | SCRT2 |
| CCATGCCGCCAT | 77 | YY2 | NNGGAAGTGCTTCCNN | 424 | ETV7 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| CCCCGCGC | | SLC13A4 | NNGGATTANN | 425 | DMBX1 |
| CGCAGCTGCG | 78 | NHLH1 | NNGGATTANN | 426 | DPRX |
| CGCGAAAa | | VANGL2 | NNMCGCCCACGCANN | 427 | EGR2 |
| CGGACACAAT | 79 | FOXK1 | NNMCGCCCACGCANNN | 428 | EGR4 |
| CGGTTGCCATGGCAAC | 80 | RFX1 | NNNNNTGCTGAN | 429 | MAFK |
| CGGTTTCAAA | 81 | CHR | NNNNTGCTGAN | 430 | NRL |
| CGTGGGTGGTCC | 82 | GLI3 | NNNTGGCGCCANNN | 431 | E2F1 |
| CTAATTAG | | PAX4 | NNRRAAAGGAAACCGAAACTN | 432 | IRF3 |
| CTGCGCATGCGC | 83 | NFE2L1 | NNTAAACGNN | 433 | BARHL2 |
| CTTCGAG | | XBP1 | NNTAATCCGATTANN | 434 | OTX1 |
| GAAAGTGAAAGT | 84 | IRF1 | NNTAATCCNN | 435 | GSC |
| GAGGTCAAAGGTCA | 85 | NR2C2 | NNTAATCCNN | 436 | GSC2 |
| GATGACGTCATC | 86 | XBP1 | NNTAATTANN | 437 | HOXD8 |
| GATGACTCAGCA | 87 | NFE2 | NNTAATTGNN | 438 | BARHL2 |
| GATTGCATCA | 88 | APEH | NNTAATTRNN | 439 | HESX1 |
| GCACTTAA | | ISL2 | NNTCCAGATGTKN | 440 | ZBTB18 |
| GCAGCCAAGCGTGACC | 89 | PAX5 | NNTGCCAAN | | NFIX |
| GCTAATCC | | CRX | NNTGCCAANN | 441 | NFIA |
| GCTTTTCCCACA | 90 | ZNF75A | NNTTTTGGCGCCAAAANN | 442 | E2F2 |
| ggACCCt | | NRG1 | NNTTTTGGCGCCAAAANN | 443 | E2F3 |
| GGCCATAAATCA | 91 | HOXA9 | NNYAATTANN | 444 | ALX3 |
| GGGGGTGTGTCC | 92 | KLF10 | NNYAATTANN | 445 | DLX1 |
| GGGGTCAAAGGTCA | 93 | RXRA | NNYAATTANN | 446 | EMX1 |
| GGGGTCAAAGGTCA | 94 | RXRB | NNYAATTANN | 447 | EMX2 |
| GGGGTCAAAGGTCA | 95 | RXRG | NNYAATTANN | 448 | EN1 |
| GGTCACGTGA | 96 | USF1 | NNYAATTANN | 449 | EN2 |
| GGTCCCTAGGGA | 97 | EBF1 | NNYAATTANN | 450 | ESX1 |
| GTAAACA | | FOXI1 | NNYAATTANN | 451 | GBX1 |
| GTAAACA | | FOXO4 | NNYAATTANN | 452 | GBX2 |
| GTAAACA | | FOXO6 | NNYAATTANN | 453 | HOXA1 |
| GTAAACAA | | FOXO1 | NNYAATTANN | 454 | LBX2 |
| GTAAACATGTTTAC | 98 | FOXO1 | NNYAATTANN | 455 | MIXL1 |
| GTAAACATGTTTAC | 99 | FOXO3 | NNYAATTANN | 456 | MNX1 |
| GTAAACATGTTTAC | 100 | FOXO4 | NNYAATTANN | 457 | PRKRA |
| GTAAACATGTTTAC | 101 | FOXO6 | NNYMATTANN | 458 | GSX1 |
| GTAATAAAA | | HOXD12 | NNYMATTANN | 459 | GSX2 |
| GTACCTACCT | 102 | ZNF784 | NNYMATTANN | 460 | HOXA2 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| GTCACGTG | | RBPJ | NNYMATTANN | 461 | HOXB2 |
| GTCACGTGAC | 103 | ARNTL | NNYMATTANN | 462 | HOXB3 |
| GTCACGTGAC | 104 | BHLHE41 | NNYMATTANN | 463 | HOXB5 |
| GTCCCCAGGGGA | 105 | EBF1 | NNYMATTANN | 464 | HOXD4 |
| GTGCGCATGCGC | 106 | NKRF | NNYTAATTANN | 465 | VSX1 |
| GTGGGCCCCA | 107 | ZNF692 | NNYTTCCGGGAARNR | 466 | ETV7 |
| TCACACCTAGGTGTGA | 108 | T | NRAAAGTGAAAGTGN | 467 | PRDM1 |
| tCACGTG | | RBPJ | NRCACCTGNN | 468 | ID4 |
| TGACCTTTAAAGGTCA | 109 | NR4A2 | NRCAGGTGN | | SNAI2 |
| TGATGACGTCATCA | 110 | BATF3 | NRCATTCCWN | 469 | TEAD4 |
| TGCCACGTGGCA | 111 | CREB3L1 | NRGATAATCYN | 470 | DPRX |
| tGCTGGT | | ACE2 | NRGTCCAAAGTCCANY | 471 | HNF4A |
| TGGCAGTTGG | 112 | MYBL1 | NRTTACGTAAYN | 472 | DBP |
| TTACGTAA | | GMEB2 | NRTTACGTAAYN | 473 | EPAS1 |
| TTACTAA | | ARRB1 | NRYTTCCGGH | 474 | FLIT |
| TTgccATggCAAC | 113 | RFX1 | NSTAATTANN | 475 | HOXA3 |
| tTgTTTac | | FOXO1 | NSTAATTANN | 476 | MEOX1 |
| TTTAAAGGTCA | 114 | NR4A2 | NSTAATTANN | 477 | MEOX2 |
| TTTCCCCACAC | 115 | FOXO3 | NTAATCCN | | OTX1 |
| TTTCCCCACACG | 116 | FOXO1 | NTAATCCN | | OTX2 |
| TTTCCCCACACG | 117 | FOXO4 | NTAATCCN | | PITX1 |
| TTTCCCGCCAAA | 118 | E2F8 | NTAATTAN | | LMX1A |
| TTTGGCGCCAAA | 119 | E2F1 | NTCAAGGTCAN | 478 | ESRRA |
| TTTGGCGCCAAA | 120 | E2F4 | NTGACAGN | | MEIS3P1 |
| TTTTCCATGGAAAA | 121 | NFATC1 | NTGACAN | | MEIS1 |
| AAAAAGCGGAAGTN | 122 | SPI1 | NTTAATCCN | | PITX1 |
| AAAAATGGCGCCAAAANN | 123 | E2F2 | NWAACCACADNN | 479 | RUNX2 |
| AAAGATCAAAGGRWW | 124 | LEF1 | NYAATTAN | | DLX2 |
| AACCCGGAAGTN | 125 | ELF1 | NYAATTAN | | DLX3 |
| AACCCGGAAGTR | 126 | ELF1 | NYAATTAN | | DLX4 |
| AACCCGGAAGTR | 127 | ELF4 | NYAATTAN | | DLX5 |
| AACCGTTAACGGNN | 128 | MYBL2 | NYAATTAN | | DLX6 |
| ACCCGGAAGTN | 129 | ELF5 | NYAATTAN | | EN1 |
| ACCGGAAGTN | 130 | ELK1 | NYAATTAN | | ISX |
| ACCGGAAGTN | 131 | ELK3 | NYAATTAN | | LHX9 |
| ACCGGAAGTN | 132 | ERF | NYAATTAN | | LMX1B |
| ACCGGAAGTN | 133 | ETV3 | NYAATTAN | | MSX1 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| ACCGGAAGTN | 134 | ETV4 | NYAATTAN | | MSX2 |
| ACCGGAAGTN | 135 | FEV | NYAATTAN | | PRRX1 |
| ACCGGAAGTN | 136 | GABPA | NYAATTAN | | PRRX2 |
| ACCGGAARYN | 137 | ETS1 | NYAATTAN | | RAX2 |
| ACCGGAARYN | 138 | ETV1 | NYAATTAN | | SHOX |
| ACCGGAARYN | 139 | FLI1 | NYAATTAN | | SHOX2 |
| AGATAAN | | GATA1 | NYAATTAN | | UNCX |
| AGATAANN | | GATA3 | NYMATAAAN | | CDX1 |
| AGATAANN | | GATA4 | NYMATAAAN | | CDX2 |
| AGATAANN | | GATA5 | NYMATTAN | | HOXA7 |
| AGATAASR | | GATA3 | NYMATTAN | | NKX6-1 |
| AGGTGTGANN | 140 | TBR1 | NYMATTAN | | NKX6-2 |
| AGGTGTNR | | TBX3 | NYMATTAN | | PDX1 |
| CCAATAAAAN | 141 | HOXA13 | NYNATTAN | | BARX1 |
| CCAATAAAAN | 142 | HOXB13 | NYNATTAN | | BSX |
| CCAATAAAAN | 143 | HOXC13 | NYTAATCCN | | PITX1 |
| CCGAAACCGAAACY | 144 | IRF5 | NYTAATCCN | | PITX3 |
| cTCGAGG. | | XBP1 | NYTAATTARN | 480 | LHX6 |
| gCTTCCw | | NR3C1P1 | NYTAGTTAMN | 481 | HMBOX1 |
| GGCGGGAAAH | 145 | E2F4 | NYYTGTTTACHN | 482 | FOXP1 |
| GGCGGGAARN | 146 | E2F6 | RACATATGTY | 483 | NEUROG2 |
| GHCACGTG | | CLOCK | RAGGTCAAAAGGTCAAKN | 484 | RARA |
| GNCACGTG | | ARNTL | RATAAAAR | | CPEB1 |
| GTAAACAW | | FOXO3 | RCGGACACAATR | 485 | FOXG1 |
| TCAAGGTCAWN | 147 | ESRRB | RGGATTAR | | GSC |
| tgCACCy | | FAM64A | RGGcAm | | EGLN2 |
| tgCATTT. | | CST6 | RGGGCACTAACY | 486 | ZNF264 |
| tGCTGg.. | | SWI5 | RRGGTCAAAGTCCRNN | 487 | HNF4A |
| TGCTTTCTAGGAATTMM | 148 | BCL6B | RRGGTCAN | | NR2F1 |
| TGGGGAAGGGCM | 149 | ZNF467 | RRGGTCATGACCYY | 488 | RXRA |
| TTGACAGS | | MEI52 | RRGGTCATGACCYY | 489 | RXRG |
| TTTTCCCGCCAAAW | 150 | E2F7 | RTCACGTGAY | 490 | SREBF2 |
| aaa.GTAAACAa | | FOXG1 | RTCACGTGAY | 491 | TFEB |
| AACAATAMCATTGTT | 151 | SOX15 | RTCACGTGAY | 492 | TFEC |
| AACAATANCATTGTT | 152 | SRY | RTCACGTGAY | 493 | USF1 |
| AACAATKNYAGTGTT | 153 | SOX8 | RTGCCMNNN | | HIC2 |
| AACAATNNCATTGTT | 154 | SOX18 | SCACGTGS | | MYCLP1 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| AACAATNNNAGTGTT | 155 | SOX10 | SYMATTAN | | HOXA6 |
| AACAATNNNCATTGTT | 156 | SRY | VCAGCTGBNN | 494 | TCF12 |
| AACAVBTGTT | 157 | MYF6 | WATGCGCATW | 495 | POU5F1 |
| AACCGGWNNNWCCGGTT | 158 | GRHL1 | WRCGTAACCACGYN | 496 | GMEB2 |
| AAGAACATWHTGTTC | 159 | PGR | YGCGCATGCGCN | 497 | NFE2L1 |
| AAGGTCANNNNAAGGTCA | 160 | ESRRG | yGCGGCk. | | SULT1A1 |
| AANTAGGTCAGTAGGTCA | 161 | RORB | YRATTGCAATYR | 498 | LHX6 |
| AARGGTCAAAAGGTCA | 162 | RARB | YTAATTAN | | VAX1 |
| ACAATANCATTG | 163 | SOX14 | YTAATTAN | | VAX2 |
| ACCGGAWATCCGGT | 164 | ERG | YTAATTAN | | VSX1 |
| ACCGGAWATCCGGT | 165 | FLI1 | YTAATTAN | | VSX2 |
| ACCGTTARRACCGTTA | 166 | MYBL2 | ...a...gTAAACAa | | FOXG1 |
| ACTACTAwwwwTAG | 167 | TMEM50A | .gCsGgg | | SLC13A4 |
| ACVAGGAAGT | 168 | ELF5 | DATGASTCAT | 499 | BATF |
| AGATGKDGAGATAAG | 169 | GATA3 | kGmCAGCGTGTC | 500 | TRIM3 |
| AGGTCANNNNNTGACCT | 170 | NR4A2 | NAACAATTKCAGTGTT | 501 | SOX4 |
| AGGTGTGAANTTCACACCT | 171 | TBX15 | ATTTCCNGGAAAT | 502 | STAT1 |
| AGGTGTGAAWTTCACACCT | 172 | TBX1 | NCCGCCATNNT | 503 | YY2 |
| AGGTGTGAWWWTCACACCT | 173 | TBX20 | NCYAATAAAA | 504 | HOXD13 |
| AGTGTTAACAGARCACCT | 174 | ZSCAN16 | NGYAATAAAA | 505 | HOXD11 |
| ANACAGCTGC | 175 | TCF3 | NNCATCCCATAATANTC | 506 | ZNF410 |
| ANCAGCTG | | KRT7 | NNNGCATGTCCNGACATGCC | 507 | UVRAG |
| ARGGTCAAAAGGTCA | 176 | RARA | NNNGMCACGTCATC | 508 | XBP1 |
| ATAAACAANWGTAAACA | 177 | FOXG1 | NRAAGGTCAANNNNRGGTCA | 509 | RORA |
| ATCAATNNCATTGAT | 178 | SOX18 | NTGCCACGTCANCA | 510 | CREB3L1 |
| ATGAATKNYAGTC | 179 | SOX8 | NYAATTAAAANNYAATTA | 511 | MSX1 |
| ATGAATWYCATTCAT | 180 | SOX18 | NYAATTAAAANNYAATTA | 512 | MSX2 |
| ATGASTCAT | | JDP2 | RACATGTYNNRACATGTC | 513 | TP63 |
| ATGCGGGYRCCCGCAT | 181 | GCM1 | RAGGTCANTCAAGGTCA | 514 | ESRRA |
| ATGMATAATTAATG | 182 | POU4F1 | RAGGTCANTCAAGGTCA | 515 | ESRRG |
| ATTTCTNAGAAA | 183 | STAT5A | RAGTCAANAAGTCA | 516 | NR2E1 |
| AVCAGGAAGT | 184 | EHF | rCGGC...rCGGC | | SULT1A1 |
| CACGTGNNNNNCACGTG | 185 | MAX | RGTTCRNNNRGTTC | 517 | NR1I2 |
| CGatAa..sC | | APEX1 | RMATWCCA | | TEAD3 |
| CGG..........cCg | | LGALS4 | rracGCsAaa | 518 | VANGL2 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| CGGas.rsw.y.s.CCGa | | LGALS4 | RRGGTCANNNRRGGTCA | 519 | RARG |
| CTTGGCACNGTGCCAA | 186 | NF1 | RTAAACAATAAAYA | 520 | FOXJ2 |
| CWGGCGGGAA | 187 | E2F1 | RTAAACARTAAACA | 521 | FOXJ3 |
| GACCCCCCGCGNNG | 188 | GLIS2 | RTAAACAWMAACA | 522 | FOXJ2 |
| GACCCCCCGCGNNG | 189 | GLIS3 | RTAAAYA | | FOXD2 |
| GAGSCCGAGC | 190 | ZNF519 | RTAAAYA | | FOXD3 |
| GARTGGTCATCGCCC | 191 | ZNF669 | RTAAAYA | | FOXL1 |
| GCGACCACNCTG | 192 | GLI2 | RTAAAYAAACA | 523 | FOXC2 |
| ggGTGca.t | | FAM64A | rTGTAcGGrT | 524 | FHL1 |
| GGGTTTTGAAGGATGARTAGGAGTT | 193 | ZFP3 | RTGTTAAAYGTAGATTAAG | 525 | ZNF232 |
| GGNTCTCGCGAGAAC | 194 | ZBTB33 | WRTAAAYAAACAA | 526 | FOXL1 |
| GGTGTGANNTCACACC | 195 | TBX21 | WTTCGAAYG | | HSFY2 |
| GGTGTGAWATCACACC | 196 | TBX21 | YACGTAACNKACGTA | 527 | GMEB2 |
| GNCCACGTGG | 197 | MYC | yGGCGCTAyca | 528 | SNTB1 |
| GSCTGTCACTCA | 198 | PBX1 | YTGGCANNNTGCCAA | 529 | NFIX |
| GTCACGCTCNCTGA | 199 | PAX5 | YTGGCANNNNTGCCAA | 530 | NFIX |
| GTGGTCCGGATYAT | 200 | SPDEF | ...ACCCR.aCMy | | RAP1A |
| GYAATAAAA | | HOXC12 | .tGrTAGCGCCr... | 531 | SNTB1 |
| TAATTRNNYAATTA | 201 | GBX2 | KCTAWAAATAGM | 532 | MEF2A |
| TAATTRSNYAATTA | 202 | EN1 | MCCATATAWGGN | 533 | SRF |
| TAATYNAATTA | 203 | PROP1 | NAAACGATNNAN | 534 | HOMEZ |
| TAATYRATTA | 204 | PAX3 | NAACAATANCATTGTTN | 535 | SOX2 |
| TAATYRATTA | 205 | PAX7 | NAACAATKNYAGTGTTN | 536 | SOX8 |
| TAATYTAATTA | 206 | PRRX1 | NAACAATKNYAGTGTTN | 537 | SOX9 |
| TAATYYAATTA | 207 | PHOX2A | NAACAATNNNATTGTTN | 538 | SOX2 |
| TAATYYAATTA | 208 | PHOX2B | NAACCGCAAACCRCAN | 539 | RUNX2 |
| TAAYYNAATTA | 209 | PROP1 | NAACCGCAAACCRCAN | 540 | RUNX3 |
| TATGCWAAT | | POU2F3 | NAACCRCAAN | 541 | RUNX3 |
| TATGCWAAT | | POU3F4 | NAAGACGYCTTN | 542 | PROX1 |
| TATGCWAAT | | POU5F1B | NAANCGAAASYR | 543 | IRF2 |
| TCAATANCATTGA | 210 | SRY | NAASATCAAAGN | 544 | TCF7L1 |
| TCAATNNCATTGA | 211 | SOX14 | NACAYATGNN | 545 | TCF15 |
| TCAATNNNATTGA | 212 | SOX21 | NACTTCCGSCGGAARMN | 546 | ELK1 |
| TCACACCTNNNNAGGTGTGA | 213 | EOMES | NAGGTCAMSRTGACCTN | 547 | ESR1 |
| TGAATANCATTCA | 214 | SRY | NAMCCGGAAGTR | 548 | ELF2 |
| TGACAGSTGTCA | 215 | MEIS3P1 | NATCAATANCATTGATN | 549 | SOX2 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| TGACAGSTGTCA | 216 | PKNOX1 | NATCAATKNYAGTGATN | 550 | SOX8 |
| TGACAGSTGTCA | 217 | PKNOX2 | NATCAATKNYAGTGATN | 551 | SOX9 |
| TGACAGSTGTCA | 218 | TGIF1 | NATCAATNNNATTGATN | 552 | SOX2 |
| TGACAGSTGTCA | 219 | TGIF2 | NATGAATKNYAGTCATN | 553 | SOX9 |
| TGACAGSTGTCA | 220 | TGIF2LX | NATGASTCATN | 554 | NFE2 |
| TGCACACNCTGAAAA | 221 | ZSCAN4 | NCACTTNAN | | NKX2-8 |
| TGGAACAGMA | 222 | ZNF189 | NCCACTTRAN | 555 | NKX2-3 |
| TRNGTAAACA | 223 | FOXA1 | NCCGGAWATCCGGN | 556 | ERG |
| TTaGTmAGc | | YAP1 | NCCGGAWRYRYWTCCGGN | 557 | ETS1 |
| TTCCKNAGAA | 224 | STAT6 | NCCGGNNNNNNCCGGN | 558 | TFCP2 |
| TTCGAANNNTTCGAA | 225 | HSFY2 | NCGAAANYGAAACY | 559 | IRF7 |
| TTCTAGAANNTTC | 226 | HSF1 | NCGACCACCNAN | 560 | ZBTB7C |
| TTCTAGAANNTTC | 227 | HSF2 | NCTAWAAATAGM | 561 | MEF2D |
| TTCTAGAANNTTC | 228 | HSF4 | NGACCCCCACGANGN | 562 | GLIS1 |
| TTGACAGSTGTCAA | 229 | MEIS2 | NGAGGTCANNGAGTTCANNNN | 563 | CYP27B1 |
| TTTCAAGGCYCCC | 230 | PRDM4 | NGCCNNNNGGCN | 564 | TFAP2A |
| TTTCCAYNRTGGAAA | 231 | NFATC1 | NGCCNNNNGGCN | 565 | TFAP2B |
| TTTCCCCACACRAC | 232 | FOXO6 | NGCCNNNNGGCN | 566 | TFAP2C |
| TTTTATKRGG | 233 | HOXB13 | NGCCNNNNNGGCN | 567 | TFAP2C |
| AAAAAGMGGAAGTN | 234 | SPIB | NGGGGAWTCCCCN | 568 | NFKB1 |
| AAAAAGNGGAAGTN | 235 | SPIC | NGGGGAWTCCCCN | 569 | NFKB2 |
| AACCGGAARTR | 236 | ETV2 | NGTCGTWAAAN | 570 | HOXC11 |
| ACCGGAARTN | 237 | ELK4 | NGTCGTWAAANN | 571 | HOXA10 |
| ACCGGAARTN | 238 | ERG | NHAACBGYW | 572 | MYBL2 |
| ACCGGAWATCCGGN | 239 | FLI1 | NMCGCCCMCGCANN | 573 | EGR1 |
| ACCGGAWGYN | 240 | ETV5 | NMCRATTAR | | VENTX |
| AGGTCANTGACCTN | 241 | NR1H4 | NNAAAATCRATANN | 574 | ONECUT3 |
| AMCCGGATGTN | 242 | SPDEF | NNAAAATCRATAWN | 575 | ONECUT1 |
| AVYTATCGATAD | 243 | ZBED1 | NNAAAATCRATAWN | 576 | ONECUT2 |
| AWCGAAACCGAAACY | 244 | IRF9 | NNATGAYGCAATN | 577 | ATF4 |
| CCAAT.a. | | NFYA | NNCAMTTAANN | 578 | HMX1 |
| CCCATWAAAN | 245 | HOXC10 | NNCAMTTAANN | 579 | HMX2 |
| CCGGAASCGGAAGTN | 246 | ETV6 | NNCAMTTAANN | 580 | HMX3 |
| CCWGGAATGY | 247 | TEAD2 | NNMCCATATAWGGKNN | 581 | SRF |
| CCWGGAATGY | 248 | TEAD4 | NNNNTGCTGASTCAGCANNNN | 582 | MAFG |
| CGSGTAA. | | VANGL1 | NNNNTGCTGASTCAGCANNNN | 583 | MAFK |
| CTCGRACCCGTGCN | 249 | ZNF524 | NNRTGACGTCAYCN | 584 | CREB3 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| CTTTCCCMYAACACKNN | 250 | ZNF282 | NNTAATCCGMTTANN | 585 | OTX2 |
| CYAATAAAAN | 251 | HOXD13 | NNTCCCNNGGGANN | 586 | EBF1 |
| GAAASYGAAASY | 252 | IRF2 | NNTNATTANN | 587 | EVX1 |
| GAATGACACRGCGN | 253 | FOXB1 | NNTNATTANN | 588 | EVX2 |
| GAGCCTGGTACTGWGCCTGR | 254 | ZNF322 | NNYATGMATAATTAATN | 589 | POU1F1 |
| GGCVGTTR |  | MYB | NRGGTCANNGGTCAN | 590 | NR2F1 |
| GNCACGTGYN | 255 | HEY2 | NRMATWCCWN | 591 | TEAD1 |
| GTAATWAAAN | 256 | HOXC10 | NRNWAAYRTTKNYN | 592 | FOXD2 |
| GTCACGCNNMATTAN | 257 | PAX3 | NRNWAAYRTTKNYN | 593 | FOXD3 |
| GTCGTWAAAN | 258 | HOXC10 | NRTTAATNATTAACN | 594 | HNF1A |
| GTCGTWAAAN | 259 | HOXD11 | NRTTAATNATTAACN | 595 | HNF1B |
| GTTAATNATTAAY | 260 | HNF1B | NRTTACRTAAYN | 596 | NFIL3 |
| TAATCRATAN | 261 | CUX1 | NRTTACRTAAYN | 597 | TEF |
| TAATCRATAN | 262 | CUX2 | NSCCNNNGGSN | 598 | TFAP2A |
| TRTTTACTTW | 263 | FOXM1 | NSCCNNNGGSN | 599 | TFAP2B |
| TSAAGGTCAN | 264 | ESRRG | NSCCNNNGGSN | 600 | TFAP2C |
| TTACGYAM |  | GMEB2 | NSCCNNNNNGGSN | 601 | TFAP2A |
| TTGGCANNNTGCCAR | 265 | NFIA | NSCCNNNNNGGSN | 602 | TFAP2B |
| TTGGCANNNTGCCAR | 266 | NFIB | NSCCNNNNNGGSN | 603 | TFAP2C |
| A.yTrAAt |  | ARRB1 | NSCTMATTAN | 604 | POU6F2 |
| AACAATNNNAKTGTT | 267 | SOX21 | NTAATTANNNTAATTAN | 605 | MEOX2 |
| AACAATNNNNAKTGTT | 268 | SOX21 | NTAATYNRATTAN | 606 | ALX3 |
| AACAATNNNNAKTGTT | 269 | SOX7 | NTAATYNRATTAN | 607 | ALX4 |
| AAGGKGRCGCAGGCA | 270 | ZNF165 | NTAATYNRATTAN | 608 | UBA2 |
| ACCCTmAAGGTyrT | 271 | ZNF569 | NTAATYTAATTAN | 609 | ISX |
| ACNGTTAAACNG | 272 | MYBL1 | NTAATYTAATTAN | 610 | UNCX |
| AkGmCACGTA | 273 | TRIM3 | NTAAYYNAATTAN | 611 | DRGX |
| AMCATATGKT | 274 | OLIG2 | NTAAYYYAATTAN | 612 | ALX1 |
| AMCATATGKT | 275 | OLIG3 | NTATCGCGAYATR | 613 | ZBED1 |
| ANCATATGNT | 276 | BHLHE23 | NTATGCWAATN | 614 | POU2F2 |
| ANCATATGNT | 277 | OLIG1 | NTATYGATCH | 615 | ONECUT1 |
| ANRTAAAYAAACA | 278 | FOXC1 | NTGAATNNCATTCAN | 616 | SOX14 |
| ARRGGTCANNNRRGGTCA | 279 | RARA | NTGAATNNNATTCAN | 617 | SOX2 |
| AWCAGCTGWT | 280 | TFAP4 | NTGAATWNCATTCAN | 618 | SOX2 |
| AWNTAGGTCATGACCTANWT | 281 | RORB | NTGACCTNNNNNAGGTCAN | 619 | THRB |
| CCCGCNTNNNNRCGAA | 282 | CENPB | NTGCCACGTCAYCN | 620 | CREB3 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| cCr.RTcrGG | | ASCL1 | NTGCTGANTCAGCRN | 621 | MAFK |
| CGTRNAAARTGA | 283 | MSC | NTGCTGASTCAGCAN | 622 | MAFF |
| CNNBRGCGCCCCTGSTGGC | 284 | CTCFL | NTGMATAATTAATGAN | 623 | POU4F3 |
| GACCACMCACNNNG | 285 | GLI2 | NTMATCATCATTAN | 624 | MEOX2 |
| GCCMCGCCCMC | 286 | AZF1 | NTTRCGCAAY | 625 | CEBPB |
| GCCMCGCCCMC | 287 | KLF16 | NTTRCGCAAY | 626 | CEBPD |
| GCCMCGCCCMC | 288 | PSG1 | NTTRCGCAAY | 627 | CEBPE |
| GNCACGTGNC | 289 | HES1 | NTTRCGCAAY | 628 | CEBPG |
| GRGGTCAAAAGGTCANA | 290 | RARG | NWACAYRACAWN | 629 | IRX2 |
| GRGGTCAAAAGKTCAC | 291 | RARG | NWACAYRACAWN | 630 | IRX5 |
| GRGTTCANNRRGTTCA | 292 | CYP27B1 | NWTATGCWAATN | 631 | POU2F1 |
| GTCWGCTGTYYCTCT | 293 | ZNF317 | NWTATGCWAATTW | 632 | POU3F3 |
| GTtgyCATgG.aAc | 294 | RFX1 | NYAATTARNNNYAATTAN | 633 | PDX1 |
| GYCATCMATCAT | 295 | HOXA2 | NYTMATTANN | 634 | NOTO |
| TAATTAGYRYTRATTA | 296 | LHX6 | RACCGTTAAACNGYY | 635 | MYBL2 |
| TAATTRCYAATTA | 297 | LHX9 | RCATTCCNNRCATTCCN | 636 | TEAD3 |
| TGAATNNNAKTCA | 298 | SOX21 | RCTAWAAATAGM | 637 | BORCS8-MEF2B |
| TGAATRTKCAGTCA | 299 | SOX10 | RRGGTCANNNGGTCAN | 638 | NR2F1 |
| TGGKCTARCCTCGA | 300 | ZKSCAN3 | RTMATTAN | | HOXA4 |
| TTCya.....TTC | | HSF1 | SCTMATTANN | 639 | POU6F2 |
| tttCC.rAt..gg | | SRF | WAACCRCAN | | RUNX2 |
| TTTCGCNTGGCNNGTCA | 301 | ZBTB49 | WGTAAAYAN | | FOXB1 |
| TWCCCAYAATGCATTG | 302 | ZNF143 | WTATGCWAATNW | 640 | POU3F1 |
| AGATSTNDNNNDSAGATAASN | 303 | GATA3 | YAATTANNCTAATTR | 641 | LHX2 |
| ARGAGGMCAAAATGW | 304 | ZNF675 | YMATTARYTAATKR | 642 | EMX1 |
| ATTTCCCAGVAKSCY | 305 | ZNF143 | YMATTARYTAATKR | 643 | EMX2 |
| GGmraTA.CGs | | APEX1 | YTCACACCTNNAGGTGTGAR | 644 | TBX1 |
| AACAATRTKCAGWGTT | 306 | SOX10 | DGGGYGKGGC | 645 | KLF5 |
| AACAATRTKCAGWGTT | 307 | SOX8 | NGACCACMCACGWNG | 646 | GLI3 |
| AACAATRTKCAGWGTT | 308 | SOX9 | NGCCACGCCCMCNT | 647 | SP6 |
| ADGGYAGYAGCATCT | 309 | PRDM9 | NTGMATAATTAATKAG | 648 | POU4F2 |
| AGGTGTKANGGTGTSA | 310 | TBX20 | NWTATGCWAATKAG | 649 | POU1F1 |
| AGGTGTKANNTMACACCT | 311 | MGAM | rGAA..TtctrGAA | | HSF1 |
| AGGTGTNANWWNTNACACCT | 312 | TBX4 | RGGTCANNNARRGGTCA | 650 | RARA |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| AGGTGTNANWWNTNACACCT | 313 | TBX5 | RGKGGGCGKGGC | 651 | SP6 |
| ATCAATRTKCAGWGAT | 314 | SOX9 | RRGGTCANNNARAGGTCA | 652 | RARG |
| ATCRATNNNNNATCRAT | 315 | CUX1 | rTCAyt....Acg | | MSC |
| ATCRATNNNNNNATCRAT | 316 | CUX1 | rTGTayGGrtg | 653 | FHL1 |
| ATCRATNNNNNNATCRAT | 317 | CUX2 | SAAGGTCANNTSAAGGTCA | 654 | ESRRA |
| ATGAATRTKCAGWCAT | 318 | SOX9 | sc.GC.gg | | EGLN2 |
| CCTCATGGTGYCYTWYTCCCTTGTG | 319 | ZNF41 | SMCAGTCWGAKGGAGGAGGC | 655 | ZSCAN22 |
| GACCMCCYRMTGNG | 320 | ZIC1 | WTATGCWAATKA | 656 | POU3F2 |
| gcsGsg..sG | | SLC13A4 | .rTCAyt.y..ACG. | | MSC |
| GGMTNAKCC | | RHOXF1 | MACCTTCYATGGCTCCCTAKTGCCY | 657 | ZNF16 |
| GGTGTNANWWNTNACACC | 321 | TBX2 | NAACAATKNYAKTGTTN | 658 | SOX7 |
| GGYGTGANNNNTCACRCC | 322 | MGAM | NANCATATGNTN | 659 | BHLHE22 |
| GRTGMTRGAGCC | 323 | ZNF415 | NATGAATKNYAKTCATN | 660 | SOX7 |
| TAAWYGNNNNTAAWYG | 324 | BARHL2 | NATGGAAANWWWWTTTYCMN | 661 | NFATC1 |
| TGAATRTKCAGWCA | 325 | SOX8 | NCAGNAAGAMGTAWMM | 662 | SPDEF |
| TGMATWWWTNA | 326 | POU3F4 | NCGCCMYCTAGYGGTN | 663 | CTCF |
| tGyayGGrtg | 327 | RAP1A | NGNTCTAGAACCNGV | 664 | ZBTB12 |
| tktCC..wTt.GGAAA | | SRF | NGTCACGCWTSRNTGNNY | 665 | PAX2 |
| TNACACCTNNNAGGTGTNA | 328 | TBX21 | NGTCACGCWTSRNTGNNY | 666 | PAX5 |
| TRGGTYASTAGGTCA | 329 | NR1D2 | NGTTNCCATGGNAACN | 667 | RFX3 |
| TYTCACACCTNNNAGGTGARA | 330 | TBX1 | NGTTNCCATGGNAACN | 668 | RFX4 |
| AAACYKGTTWDACMRGTTTB | 331 | GRHL2 | NGTTRCCATGGYAACN | 669 | RFX2 |
| GACCCCCYGYTGNGN | 332 | ZIC3 | NGTTRCCATGGYAACN | 670 | RFX5 |
| GACCCCCYGYTGNGN | 333 | ZIC4 | NGYAATWAAAN | 671 | HOXA10 |
| TTTYACGCWTGANTGMNYN | 334 | PAX6 | NGYAATNAAAN | 672 | HOXC11 |
| ACCYTmArGGT.rTG | 335 | ZNF569 | NMCMCGCCCMCN | 673 | SP8 |
| CNATTAAAWANCNATTA | 336 | BARX1 | NNGNNACGCCCMYTTTNN | 674 | KLF13 |
| TAGAYRAYTGMCANGAA | 337 | ZNF713 | NRTMAATATTKAYN | 675 | FOXC1 |
| TWGHWACAWTGTWDC | 338 | DMRT1 | NRTMAATATTKAYN | 676 | FOXC2 |
| GNCTGTASTRNTGBCTCHTT | 339 | ZNF382 | NTAATTRGYAATTAN | 677 | HESX1 |
| ....gTAAACAa | | FOXO1 | NTGACCTNATNAGGTCAN | 678 | THRA |
| KCCACGTGAC | 340 | NPAS2 | NTGACCTNATNAGGTCAN | 679 | THRB |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| MCGCCCACGCA | 341 | EGR2 | NTGTTTACRGTAAAYAN | 680 | FOXI1 |
| NACCCGGAAGTA | 342 | EHF | NTRAKCCN | | RHOXF1 |
| NAGGTGTGAA | 343 | TBX21 | NTRAYNTAATCAN | 681 | DUXA |
| NATGCGGGTA | 344 | GCM1 | NWRGCCMCGCCCMCTNN | 682 | SP4 |
| NCCACGTG | | MYC | NWTRMATATKYAWN | 683 | POU2F1 |
| NCCACTTAA | | NKX3-1 | NWTRMATATKYAWN | 684 | POU2F2 |
| NCCACTTAA | | NKX3-2 | RCATTCCNNRCATWCCN | 685 | TEAD1 |
| NCCCCCCCAC | 345 | ZNF740 | RTGGAAAANTMCNN | 686 | NFAT5 |
| NCGAAACCGAAACT | 346 | IRF8 | SGTTGCYARGCAACS | 687 | RFX2 |
| NNCACGTGCC | 347 | HEY2 | SGTTGCYARGCAACS | 688 | RFX3 |
| NNGCGGAAGTG | 348 | ETV7 | SGTTGCYARGCAACS | 689 | RFX4 |
| NTGGGTGTGGCC | 349 | KLF1 | SGTTRCCATRGCAACS | 690 | RFX5 |
| NTTTCCAGGAAA | 350 | STAT4 | SSYTAATCGRWAANCGATTAR | 691 | VENTX |
| rACGCGt | | MBL2 | w.TTRamkAR | | SPTLC2 |
| rCACAAT | | MAT1A | WAWRTAAAYAWW | 692 | FOXC2 |
| RCCGGAAGTG | 351 | ETS2 | WNWGTMAATATTRACWNW | 693 | FOXB1 |
| RRGGTCAAAAGGTCA | 352 | NR2F6 | WRWGTMAAYAN | 694 | FOXB1 |
| RRGGTCAAAGGTCA | 353 | HNF4A | WRWRTMAAYAW | 695 | FOXC1 |
| RRGGTCAAAGGTCA | 354 | NR2C2 | WTAATKAGCTMATTAW | 696 | POU6F2 |
| RRGGTCAAAGGTCA | 355 | NR2F6 | ymtGTmTytAw | 697 | SPTLC2 |
| RRGTCCAAAGGTCAA | 356 | HNF4A | NGTGTTCAVTSAAGCGKAAA | 698 | PAX6 |
| RTAAACA | | FOXP3 | NWTGMATAAWTNA | 699 | POU3F2 |
| RTAAACAA | | FOXJ2 | SGTCACGCWTGANTGMA | 700 | PAX1 |
| RTAAACAA | | FOXJ3 | SGTCACGCWTGANTGMA | 701 | PAX9 |
| RTAAACATAAACA | 357 | FOXJ3 | VAGRACAKNCTGTBC | 702 | PGR |
| RTCATGTGAC | 358 | MITF | WAWNTRGGTYAGTAGGTCA | 703 | RORA |
| VDTTTCCCGCCA | 359 | E2F7 | WTGMATAAWTNA | 704 | POU3F1 |
| WACCCGGAAGTA | 360 | ELF3 | WTGMATAAWTNA | 705 | POU3F3 |
| WDNCTGGGCA | 361 | ZNF416 | WTRMATATKYAW | 706 | POU2F3 |
| wwwwsyGGGG | 362 | VPS4B | WTRMATATKYAW | 707 | POU3F3 |
| YGTCTAGACA | 363 | SMAD3 | WTRMATATKYAW | 708 | POU5F1B |
| yTGACT | | ASCL1 | YTKGATAHAGTATTCTWGGTNGGCA | 709 | ZNF136 |
| .gcTgAcTAA. | | YAP1 | NNCNGTTNNNACNGTTN | 710 | MYBL1 |
| DNNNGGTCANNNH | 364 | NR2F1 | NRGNACANNNTGTNCYN | 711 | NR3C2 |
| HAATAAAGNN | 365 | PABPC1 | NRGWACANNNTGTWCYN | 712 | NR3C1 |
| HNHNAGGTGTGANHH | 366 | TBX20 | NTGACCTYANNTRAGGTCAN | 713 | THRB |
| kGCTGr | | SWI5 | RAANCGAAAWTCGNTTY | 714 | IRF7 |

TABLE 34-continued

Motifs for Binding Sites or Signaling Centers

| Motif Sequence | SEQ ID NO | Gene symbol | Motif Sequence | SEQ ID NO | Gene symbol |
|---|---|---|---|---|---|
| KSYGGAAGTN | 367 | ETV6 | RRGWACANNNTGTWCYY | 715 | AKR1B1 |
| NAAACCGGTTTN | 368 | GRHL1 | WAACCRCAAWAACCRCAN | 716 | RUNX2 |
| NAACAATRN | | SOX9 | WAACCRCAAWAACCRCAN | 717 | RUNX3 |
| NAACCGCAAN | 369 | RUNX3 | NNTCRCACNTANGTGYGANN | 718 | TBX19 |
| NAACCGGTTN | 370 | GRHL1 | YwTTkcKkTyyckgykky | 719 | AZF1 |

TABLE 35

Motifs for Binding Sites or Signaling Centers

| Motif Sequence | SEQ ID NO | Complex_name |
|---|---|---|
| ACCGGAAATGA | 720 | HOXB2:ETV1 |
| CCATAAATCA | 721 | PBX4:HOXA10 |
| TAAACAGGATTA | 722 | FOXJ2:PITX1 |
| TGTCAATTA | | MEIS1:DRGX |
| ACCGGAAACAGCTGNN | 723 | TFAP4:FLI1 |
| ACCGGAAATGAN | 724 | HOXB2:ETV4 |
| AGGTGTTAATKN | 725 | HOXB2:TBX3 |
| AGGTGTTGACAN | 726 | MEIS1:EOMES |
| CTCGTAAATGYN | 727 | TEAD4:HOXB13 |
| GAAAACCGAAAN | 728 | FLI1:FOXI1 |
| GGAATGCGGAAGTN | 729 | TEAD4:ELF1 |
| GGAATGTTAATTR | 730 | TEAD4:DRGX |
| GTGCGGGCGGAAGTN | 731 | GCM1:ELF1 |
| TCACACCGGAWRY | 732 | ETV2:EOMES |
| TGTTGCCGGANNN | 733 | FOXO1:ELK1 |
| ACAAWRSNNNNNYMATTA | 734 | HOXB2:SOX15 |
| ACAAWRSNNNNYMATTA | 735 | HOXB2:SOX15 |
| ACAWRSNNNYMATTA | 736 | HOXB2:SOX15 |
| AGGTGTKAAGTCGTAAA | 737 | HOXD12:TBX21 |
| CAGCTGNNNNNNNNNNNNTGCGGG | 738 | GCM1:FIGLA |
| CAGCTGNNNNNNNNNNTGCGGG | 739 | GCM1:FIGLA |
| CAGCTGNNNNNNNNTGCGGG | 740 | GCM1:FIGLA |
| CAGCTGNNNNNNNTGCGGG | 741 | GCM1:FIGLA |
| CCGGAANNNNNNNCACGTG | 742 | ETV5:HES7 |
| GGAATGNNNNNYTAATTA | 743 | TEAD4:ALX4 |
| GGATTANNNNNNNNNNTGCGGG | 744 | GCM1:PITX1 |
| GGATTANNNNNNNNTGCGGG | 745 | GCM1:PITX1 |

TABLE 35-continued

Motifs for Binding Sites or Signaling Centers

| Motif Sequence | SEQ ID NO | Complex_name |
|---|---|---|
| GGATTANNNNNNTGCGGG | 746 | GCM1:PITX1 |
| GGTGTGNNNNNCACGTG | 747 | CLOCK:TBX3 |
| TAATKNNNNNNNNAAGGTCA | 748 | HOXB2:ESRRB |
| TAATKRNGGATTA | 749 | HOXB2:PITX1 |
| TAATKRNNNNGCAAC | 750 | HOXB2:RFX5 |
| TAATKRNNNNGGATTA | 751 | HOXB2:PITX1 |
| TAATKRNNNNGGATTA | 752 | PITX1:HOXA3 |
| TAATKRNNNNNGCAAC | 753 | HOXB2:RFX5 |
| TAATKRNNNNNNAAGGTCA | 754 | HOXB2:ESRRB |
| TAATKRNRNGGATTA | 755 | HOXB2:PITX1 |
| TAATTANNNNNNCACGTG | 756 | CLOCK:EVX1 |
| TGACANNNNNTCATTA | 757 | MEIS1:EVX1 |
| TGACANSNTAATTG | 758 | MEIS1:DLX3 |
| TMACACCGGAAG | 759 | ERF:TBX21 |
| TNTCACACCGGAAAT | 760 | ERF:EOMES |
| ACCCGCANCCGGAAGN | 761 | GCM1:ELK3 |
| ACCGGANNTACGCNNNNNYR | 762 | ETV2:PAX5 |
| AGGTGNTAATKR | 763 | MGA:DLX3 |
| AGGTGNTAATKW | 764 | MGA:EVX1 |
| AGGTGNTAATTR | 765 | MGA:DLX2 |
| ATTTGCATNACAATRN | 766 | POU2F1:SOX2 |
| CACGTGNNNGCGGGY | 767 | GCM1:MAX |
| CACGTGNNNNNSRGGAARNN | 768 | ERF:CLOCK |
| CACGTGNNNRGATTAN | 769 | ARNTL:PITX1 |
| CAGCTGNNNNNNCCCGCAY | 770 | GCM1:FIGLA |
| CYAATAAAATGYN | 771 | TEAD4:HOXB13 |
| GTMACAGGAWRN | 772 | ETV5:FOXI1 |
| GTMAATAAGGGYRN | 773 | GCM1:FOXO1 |
| TAATGNNNNNCGGAAGTN | 774 | HOXB2:ELK3 |
| TAATKRCCGGAAGNN | 775 | HOXB2:ELK1 |
| TAATKRNNNNGGAAGTN | 776 | HOXB2:ELF1 |
| TAATKRNNNNNGGAAGTN | 777 | HOXB2:ELF1 |
| TAATTRNNNNCGGAARYN | 778 | ETV2:DLX3 |
| TGACAKNNNAACAATGN | 779 | MEIS1:SOX2 |
| TGACANNNTAATKR | 780 | MEIS1:DLX2 |
| TGACASTAATKR | 781 | MEIS1:DRGX |
| TGTTGANGCGGGN | 782 | GCM1:FOXI1 |
| TGTTGNCGGAWRN | 783 | ETV5:FOXI1 |

TABLE 35-continued

Motifs for Binding Sites or Signaling Centers

| Motif Sequence | SEQ ID NO | Complex_name |
| --- | --- | --- |
| TGTTKMCGGAWRN | 784 | ERF:FOXI1 |
| TGTTKMCGGAWRNN | 785 | FLI1:FOXI1 |
| TNRCACCGGAAGN | 786 | ELK1:EOMES |
| TNRCACCGGAAGNN | 787 | ELK1:TBX21 |
| TNRCACCGGAWN | 788 | ETV5:EOMES |
| TTACGTNNNNNNNNNNCCGGAANN | 789 | ETV2:TEF |
| ACCGGAARTNNNYAATTA | 790 | FLI1:DLX2 |
| AGGTGNGAARGGATTA | 791 | PITX1:TBX21 |
| AGGTGTGNNNNNATCRAT | 792 | CUX1:TBX3 |
| ANCCGGATNNNNNNNMATTA | 793 | HOXB2:SPDEF |
| ARGTGNNNNNNNATAAA | 794 | HOXB13:TBX21 |
| ATCRATNNNNNNNNNSYATTGTT | 795 | CUX1:SOX15 |
| CACGTGNNNTAATKAT | 796 | CLOCK:EVX1 |
| CASSTGNNNNNNNNNNNNNTGCGGG | 797 | GCM1:FIGLA |
| CASSTGNNNNNNNNNNNNTGCGGG | 798 | GCM1:FIGLA |
| CASSTGNNNNNNNNNNTGCGGG | 799 | GCM1:FIGLA |
| CASSTGNNNNNNNNTGCGGG | 800 | GCM1:FIGLA |
| CYCATAAANNTGTCA | 801 | MEIS2:HOXA13 |
| GGAATKNNCASSTG | 802 | TEAD4:FIGLA |
| GGWATGNNNNRTAAA | 803 | TEAD4:HOXA13 |
| GGWATGNNNRTAAA | 804 | TEAD4:HOXB13 |
| GTTGCYNNNNNNNNNNNNNNCASSTG | 805 | RFX3:FIGLA |
| GWMAACANNSYMRTAAA | 806 | FOXO1:HOXB13 |
| GWMAACAYMRTAAA | 807 | FOXO1:HOXB13 |
| TAATCCNNNNCASSTG | 808 | PITX1:FIGLA |
| TAATKAGGTGNKA | 809 | HOXA3:EOMES |
| TAATKANNGGATTA | 810 | HOXB2:PITX1 |
| TAATKRGGTGYKA | 811 | HOXB2:EOMES |
| TAATKRGGTGYKA | 812 | HOXB2:TBX21 |
| TMACACCYAATA | 813 | CUX1:TBX21 |
| TTTWATNRNMAACA | 814 | FOXJ2:HOXB13 |
| AGGTGNTAATKWNNNNTN | 815 | MGA:EVX1 |
| AGGTGTGNCSGTTR | 816 | MYBL1:TBX21 |
| AGGTGTNNNGSGGGN | 817 | GCM2:TBX21 |
| AGGTGTNRTRCGGGNN | 818 | GCM1:TBX21 |
| ANGTGTGAATWCY | 819 | TEAD4:TBX21 |
| ANGTGTSNNATAAAN | 820 | HOXB13:EOMES |
| ATRCGGGYNNNNNYWTTGTNN | 821 | GCM2:SOX15 |

TABLE 35-continued

Motifs for Binding Sites or Signaling Centers

| Motif Sequence | SEQ ID NO | Complex_name |
|---|---|---|
| CASSTGNNCCCGCAY | 822 | GCM1:FIGLA |
| CASSTGNNCCGGAWRYN | 823 | ETV2:TCF3 |
| CASSTGNRNNGGAAGNN | 824 | ETV5:TCF3 |
| CTCRTAAAWNNNNNRMCGTTR | 825 | MYBL1:HOXA13 |
| GGATTANNARGTGTKN | 826 | PITX1:EOMES |
| GGATTANNNNATCRATN | 827 | CUX1:PITX1 |
| GGWATGNNNNNNNCACGTGN | 828 | TEAD4:CLOCK |
| GGWATGNNNNNNNNCACGTGN | 829 | TEAD4:CLOCK |
| GGWATGNRAGGTGNNR | 830 | TEAD4:EOMES |
| TAATKNNNNGNNNNNNNCTTCCNN | 831 | HOXB2:ETV7 |
| TAATKRSCGGAWGN | 832 | ETV5:DRGX |
| TGACAGNWAATCRATR | 833 | MEIS1:ONECUT2 |
| TGTTKATRCGGGN | 834 | GCM2:FOXI1 |
| TGTTKMCGGAWRTN | 835 | ETV2:FOXI1 |
| TMACACMGGAARN | 836 | ETV2:TBX21 |
| TTGCGYAANNSCGGAAGN | 837 | CEBPG:ELF1 |
| ATCRATNNNNYCRTAAA | 838 | CUX1:HOXA13 |
| ATRATYANNNNCACGTG | 839 | CLOCK:EVX1 |
| GGWATGYGTMAACA | 840 | TEAD4:FOXI1 |
| TMACACYYMRTWAA | 841 | HOXC10:EOMES |
| TMRCACCTCRTWAA | 842 | HOXD12:EOMES |
| ARGTGNNANNNMWTAAAN | 843 | HOXB13:TBX21 |
| ARGTGTKANTTTATNN | 844 | HOXB13:TBX21 |
| ARGTGTKRNNNNNNRGWATGY | 845 | TEAD4:TBX21 |
| CYCRTAAATWCCN | 846 | TEAD4:HOXA13 |
| GTMAACANNNNNATCRATN | 847 | CUX1:FOXO1 |
| TGMATATKCANNNNNTAATKR | 848 | POU2F1:DLX2 |
| TGMATATKCANNNNTAATKR | 849 | POU2F1:DLX2 |
| TNSCCNNNGGSNNNCACGTGN | 850 | TFAP2C:MAX |
| TNSCCNNNGGSNNNNCACGTGN | 851 | TFAP2C:MAX |
| TNSCCNNNGGSNNNNNNNNNNNNNCACGTGN | 852 | TFAP2C:MAX |
| TNSCCNNNGGSNNNNNNNNNNNNNNCACGTGN | 853 | TFAP2C:MAX |
| TMRCACYTMATWAA | 854 | HOXC10:TBX21 |
| ANGTGNNANNNNNNNNNNNCNNMGGAWNN | 855 | ELK1:TBX21 |
| ARGTGTNNNAATATKYNNNCRCNN | 856 | POU2F1:EOMES |
| ATRSGGGNNNNNTTRCGYAAN | 857 | GCM1:CEBPB |
| GGWATGYNNNNCRCGYGY | 858 | TEAD4:HES7 |
| GGWATGYNNNNNNCRCGYGY | 859 | TEAD4:HES7 |

TABLE 35-continued

Motifs for Binding Sites or Signaling Centers

| Motif Sequence | SEQ ID NO | Complex_name |
| --- | --- | --- |
| TRGYAACNNNNCASSTGNN | 860 | RFX3:FIGLA |
| AGGYGYGANNNNNNNNNNNNNNNNNNNTCRTWAA | 861 | HOXD12:EOMES |
| NNCGTAAAATTA | 862 | HOXB2:HOXB13 |
| NRMATATACCAATAAA | 863 | POU2F1:HOXB13 |
| NTCGTAAAATGC | 864 | TEAD4:HOXB13 |
| NTCGTAAATCA | 865 | PBX4:HOXA10 |
| RCCGGAAGTAATTA | 866 | ELK1:HOXA1 |
| YNNRTAAATCAATCA | 867 | PBX4:HOXA10 |
| NCCGGATATGCAN | 868 | POU2F1:ELK1 |
| NCCGGATATGCAN | 869 | POU2F1:ETV1 |
| NCCGGATATGCAN | 870 | POU2F1:ETV4 |
| NGATGATGCAATNN | 871 | ATF4:CEBPD |
| NGCAGCTGCCGGAWRYN | 872 | ETV2:NHLH1 |
| NGCCACGCAAYN | 873 | CEBPG:CREB3L1 |
| NMATGACACGCGCCMNN | 874 | E2F3:FOXO6 |
| NMCCGGAACCGTTR | 875 | MYBL1:ELF1 |
| NNCAGCTGCCGGAWRYN | 876 | ERF:NHLH1 |
| NNGAAAACCGAANM | 877 | FOXO1:ELF1 |
| NNMATCACATAAAN | 878 | HOXB2:HOXB13 |
| NNMCACCGCGCCCMN | 879 | E2F3:FOXI1 |
| NNNRTAAATCACACNN | 880 | HOXB13:TBX3 |
| NTGCCGGAAGTN | 881 | MEIS1:ELF1 |
| NWAAACAGGAAGNN | 882 | FOXJ2:ELF1 |
| RCCGGAAATRSY | 883 | TEAD4:FLI1 |
| RCCGGATGTTKWN | 884 | ETV2:FOXO6 |
| RCCGGATGTTKWY | 885 | FLI1:FOXI1 |
| RGAATGCGGAAGTN | 886 | TEAD4:SPIB |
| RGAATGCGGAAGTR | 887 | TEAD4:ELF1 |
| RGAATGCGGATN | 888 | TEAD4:SPDEF |
| RGGTGTTAATKN | 889 | HOXB2:EOMES |
| RMAGAAAACCGAANN | 890 | FOXJ2:ELF1 |
| RNCGGATGTTKWN | 891 | ETV5:FOXO1 |
| RNMTGATGCAATN | 892 | ATF4:TEF |
| RSCGGAAGTAATAAAN | 893 | HOXD12:ELK1 |
| RSCGGAAGTAATAAAN | 894 | HOXD12:ELK3 |
| RSCGGAAGTAATAAAN | 895 | HOXD12:ETV1 |
| RSCGGAAGTAATAAAN | 896 | HOXD12:ETV4 |
| RSCGGAAGTCGTAAAN | 897 | HOXD12:ELK3 |

TABLE 35-continued

Motifs for Binding Sites or Signaling Centers

| Motif Sequence | SEQ ID NO | Complex_name |
|---|---|---|
| RSCGGAAGTCGTAAAN | 898 | HOXD12:ETV4 |
| RSCGGATGTKKN | 899 | ELK1:FOXI1 |
| RSCGGATGTTGN | 900 | ETV5:FOXI1 |
| RSCGGATGTTKW | 901 | ETV2:FOXI1 |
| RSCGGATGTTKWN | 902 | ERF:FOXI1 |
| RSCGGTAATKR | 903 | ELK1:HOXA3 |
| RTGCGGGCGGAAGTN | 904 | GCM1:ELK1 |
| RTGCGGGCGGAAGTN | 905 | GCM1:ELK3 |
| RTGCGGGCGGAAGTR | 906 | GCM1:ETV4 |
| RTGCGGGTAATAAAN | 907 | GCM1:HOXB13 |
| RWMAACAGGAAGTN | 908 | FOXO1:ELF1 |
| RWMAACAGGAARNN | 909 | FOXO1:ETV4 |
| RWYAACAGGAAGYN | 910 | FOXO1:ELK1 |
| SGCGCTAATTKN | 911 | E2F3:DRGX |
| WAACAACACMY | 912 | FOXJ3:TBX21 |
| WMSCGGATGTKNW | 913 | FOXO1:SPDEF |
| NCACCTGNNNNNMATTA | 914 | HOXB2:TCF3 |
| NCACGTGNNGGATTA | 915 | PITX1:HES7 |
| NCAGGTGNNNNNMATTA | 916 | HOXB2:TCF3 |
| NCCCGCANNMATAAA | 917 | GCM1:HOXB13 |
| NCCCGCANNNMRTAAA | 918 | GCM1:HOXB13 |
| NCCGGAAGNNNNNNYMATTA | 919 | ETV2:HOXA2 |
| NCCGGAAGTMATTA | 920 | ETV2:HOXA2 |
| NNATCATNGTAAA | 921 | HOXB2:HOXB13 |
| NNATGAYGCAAT | 922 | CEBPG:ATF4 |
| NNMAACAYNRTAAA | 923 | HOXB13:Fox |
| NTAATCCNNWMAACA | 924 | FOXJ2:PITX1 |
| NYNATMAATCA | 925 | PBX4:HOXA1 |
| RCATTCCNNNNNNCACGTG | 926 | TEAD4:MAX |
| RCATTCCNNNNNNNNCACGTG | 927 | TEAD4:MAX |
| RCATTCCNNNYAATTA | 928 | TEAD4:DLX3 |
| RCATTCCNNNYMATTA | 929 | TEAD4:DLX3 |
| RCATTCNNNNNNCATTA | 930 | TEAD4:HOXA2 |
| RCATTCNNNNNNCATTA | 931 | TEAD4:HOXA3 |
| RCATTCNNNNNTAATCC | 932 | TEAD4:PITX1 |
| RCATTCYNNNCAATTA | 933 | TEAD4:DLX2 |
| RCATTCYNNNNCAATTA | 934 | TEAD4:DLX2 |
| RCATTCYNNNNNCATTA | 935 | TEAD4:HOXA3 |

TABLE 35-continued

Motifs for Binding Sites or Signaling Centers

| Motif Sequence | SEQ ID NO | Complex_name |
| --- | --- | --- |
| RCCGGAAATRCC | 936 | TEAD4:ETV4 |
| RCCGGAANNNNNNYAATTA | 937 | ETV2:DLX2 |
| RCCGGAANNNNNYAATTA | 938 | ETV2:DLX2 |
| RGAATGCGGAWRT | 939 | TEAD4:SPDEF |
| RGAATGCNNRTAAA | 940 | TEAD4:HOXB13 |
| RGAATGYGTGA | 941 | TEAD4:EOMES |
| RGAATGYNNACGTG | 942 | TEAD4:MAX |
| RGGTGTNNNNNNNNNYATTGT | 943 | SOX6:TBX21 |
| RKRNGGGNNATAAA | 944 | GCM1:HOXA13 |
| RNCGGAANNAAACA | 945 | ETV2:FOXI1 |
| RRAATGCARTAAA | 946 | TEAD4:HOXB13 |
| RSCGGAAATRCC | 947 | TEAD4:ERG |
| RSCGGAAGTMRTTA | 948 | HOXB2:ELK1 |
| RSCGGAAGTMRTTA | 949 | HOXB2:ELK3 |
| RSCGGAANNNNGGATTA | 950 | ETV2:GSC2 |
| RSCGGAANNNNNGGATTA | 951 | ETV2:GSC2 |
| RSCGGAANNNNNNNYWTTGT | 952 | ETV2:SOX15 |
| RSCGGAANNNNNNRTCGAT | 953 | FLI1:ONECUT2 |
| RSCGGAANNNNNNYAATTA | 954 | ETV2:DLX3 |
| RSCGGAANNNNNNYWTTGT | 955 | ETV2:SOX15 |
| RSCGGAANNNNNYAATTA | 956 | ERF:DLX3 |
| RSCGGAANNNNNYAATTA | 957 | ETV2:DLX3 |
| RSCGGAANNNNNYAATTA | 958 | ETV5:DLX2 |
| RSCGGAANNNNNYMATTA | 959 | ERF:DLX2 |
| RSCGGAANNNNYAATTA | 960 | ERF:DLX3 |
| RSCGGAANYAATTA | 961 | ETV2:DRGX |
| RSCGGAANYNRTAAA | 962 | FLI1:HOXB13 |
| RSCGGAARYAATTA | 963 | FLI1:DLX2 |
| RSCGGAWNNNNNNNYMATTA | 964 | ERF:HOXA3 |
| RSCGGAWRYATTA | 965 | ETV2:DRGX |
| SMGGAAGTMRTTA | 966 | HOXB2:ELF1 |
| SYMRTAAANCTGTCA | 967 | MEIS1:HOXB13 |
| SYNRTAAANNTGTCA | 968 | MEIS1:HOXA13 |
| YAACGGNNNNNNNNNNCACGTG | 969 | MYBL1:MAX |
| YAACGGNNNNNNNNNNNCACGTG | 970 | MYBL1:MAX |
| YRATTANNNNNNNCACGTG | 971 | CLOCK:EVX1 |
| NACAATRNNNNGAATGY | 972 | TEAD4:SOX15 |
| NACAATRNNNNNGAATGY | 973 | TEAD4:SOX15 |

TABLE 35-continued

Motifs for Binding Sites or Signaling Centers

| Motif Sequence | SEQ ID NO | Complex_name |
| --- | --- | --- |
| NACTTCCGGYNNNNGCAACSN | 974 | ETV2:RFX5 |
| NAGGTGNTAATKR | 975 | HOXB2:TBX21 |
| NCACGTGNNNNNCATATGN | 976 | CLOCK:BHLHA15 |
| NCACGTGNNNNNSCGGAWRN | 977 | ETV5:CLOCK |
| NCAGCTGNNNNNCACGTGN | 978 | TFAP4:MAX |
| NCAGCTGNNNNNNNCACGTGN | 979 | TFAP4:MAX |
| NCCGGAAGTYRTAAAN | 980 | ETV2:HOXB13 |
| NCCGGAANCATATGN | 981 | FLI1:BHLHA15 |
| NCCGGAANNNNNNNCAGCTGNN | 982 | ETV2:NHLH1 |
| NCCGGAANYATAAAN | 983 | ETV2:HOXB13 |
| NCCGGWNNNNNNNNNNNNSCATTAN | 984 | ELK1:HOXA3 |
| NGGTGTGNNGGCGCSN | 985 | E2F3:TBX21 |
| NGGTGTGNNNGGCGCSN | 986 | E2F3:TBX21 |
| NGGTGTNNNNNNNNNNNNNNNCCGGAWNNN | 987 | ETV2:EOMES |
| NMATGACACNGCGCCMNN | 988 | E2F3:FOXO6 |
| NNACAATNNNNNNNGAATGY | 989 | TEAD4:SOX6 |
| NNARAAACCGAAWMN | 990 | FOXJ3:ELF1 |
| NNATGAYGCAAYN | 991 | ATF4:CEBPB |
| NNCACGTGACMGGAARNN | 992 | ERF:SREBF2 |
| NNCACGTGNNNGCGGGYN | 993 | GCM1:MAX |
| NNCACGTGNNNNCCGGAANN | 994 | ERF:HES7 |
| NNCACGTGNNNNCCGGAANN | 995 | ETV5:HES7 |
| NNCACGTGNNNNNCCGGAANN | 996 | ERF:HES7 |
| NNCACGTGNNNNNCCGGAWRY | 997 | ETV2:CLOCK |
| NNCACGTGNNNNNCGGAWRY | 998 | ETV2:HES7 |
| NNCACGTGNNNNNNNNNRTGCGGGYRN | 999 | GCM1:MAX |
| NNCAGCTGNNNNNNNCACGTGNN | 1000 | CLOCK:NHLH1 |
| NNCAGCTGNNNNNNNNNATCGATN | 1001 | CUX1:NHLH1 |
| NNCAGCTGNNNNNNNTAATTN | 1002 | TFAP4:DLX3 |
| NNCAGCTGNNNNNTAATKR | 1003 | TFAP4:DLX3 |
| NNCAGGTGNNNNNMCGGAARYN | 1004 | ETV2:FIGLA |
| NNCGGAANCAGGTGNN | 1005 | ETV2:FIGLA |
| NNGATTANNNATGCAWNNN | 1006 | POU2F1:GSC2 |
| NNGTCACGCNNCATTAN | 1007 | HOXB2:PAX5 |
| NNGTCACGNNTCATTNN | 1008 | HOXB2:PAX1 |
| NNMGGAARNNRTAAAN | 1009 | ERF:HOXB13 |
| NNNACGANNNNNNNTCGTNNN | 1010 | HOXD12:EOMES |
| NNNCGGGNNNGGTGTNN | 1011 | GCM2:TBX21 |

TABLE 35-continued

Motifs for Binding Sites or Signaling Centers

| Motif Sequence | SEQ ID NO | Complex_name |
|---|---|---|
| NNNGMATAACAAWRRN | 1012 | POU2F1:SOX15 |
| NNNNGCGCSNNNNNCACGTGNN | 1013 | E2F3:HES7 |
| NNNRTAAANCTGTN | 1014 | HOXB13:MEIS1 |
| NNNTTCCGSNNNNGCAACNN | 1015 | ETV2:RFX5 |
| NNRNGGGCGGAARTN | 1016 | GCM2:ELK1 |
| NNSGCGCSNNNATCGAYN | 1017 | E2F3:ONECUT2 |
| NNSGCGCSNNNNATCGAYN | 1018 | E2F3:ONECUT2 |
| NNSMGGACGGAYNTCCKSNN | 1019 | ELK1:ETV7 |
| NNYMATTANNNNNNNGGAAGNN | 1020 | HOXB2:ELF1 |
| NRCAGCTGNNNNNNCACGTGNN | 1021 | CLOCK:NHLH1 |
| NRCATTCNNNNNNTAATTRN | 1022 | TEAD4:DLX2 |
| NRCATTCNNNNYAATTN | 1023 | TEAD4:DLX2 |
| NRCCCRNNCGGAAGNN | 1024 | GCM1:ELF1 |
| NRSCGGAAGNNGTAAAN | 1025 | HOXD12:ELK1 |
| NSCGGAARNCACGTGNN | 1026 | ERF:SREBF2 |
| NSCGGAARNNNNNMATTAN | 1027 | HOXB2:ETV7 |
| NSCGGAARNNNNNNMATTAN | 1028 | HOXB2:ETV7 |
| NSCGGAARNNNNNNTCACACNN | 1029 | ETV7:TBX21 |
| NSCGGAARNNNNNTCACACNN | 1030 | ETV7:TBX21 |
| NSCGGAWNTTACGTAAN | 1031 | ELK1:TEF |
| NSMGGACGGAYNTCCKSN | 1032 | ELK1:SPDEF |
| NSMGGACGGAYNTCCKSN | 1033 | ERF:ETV7 |
| NSMGGACGGAYNTCCKSN | 1034 | ETV2:ETV7 |
| NSMGGACGGAYNTCCKSN | 1035 | FLI1:ETV7 |
| NTAATKRSNMRTAAAN | 1036 | HOXD12:HOXA3 |
| NTAATNRSNYMRTAAAN | 1037 | HOXD12:HOXA3 |
| NTGACRNNNNNNCACGTGN | 1038 | MEIS1:MAX |
| NTGTTGATRNGGGN | 1039 | GCM1:FOXI1 |
| NTGTTGNCGGAARNN | 1040 | FOXO1:ELF1 |
| NTTTAYNNCCGGAARNN | 1041 | HOXD12:ELK3 |
| NYMATTANNNNNACAATR | 1042 | HOXB2:SOX15 |
| NYMATTANNNNNCAGCTGNN | 1043 | HOXB2:NHLH1 |
| NYMATTANNNNNNACAATR | 1044 | HOXB2:SOX15 |
| NYMATTANNNNNNCAGCTGNN | 1045 | HOXB2:NHLH1 |
| NYMATTANNNNNNNCAGCTGNN | 1046 | HOXB2:NHLH1 |
| NYMATTANNNNNNNNGGAAGNN | 1047 | HOXB2:ELF1 |
| RAGGTSRNNNNNNNNNNNNNNNNCGGAAGYN | 1048 | ELK1:TBX21 |
| RCATTCCNNATCGAYN | 1049 | TEAD4:ONECUT2 |

TABLE 35-continued

Motifs for Binding Sites or Signaling Centers

| Motif Sequence | SEQ ID NO | Complex_name |
|---|---|---|
| RCATTCCNNNNTAATKR | 1050 | TEAD4:DLX3 |
| RCATTCNNNNNNNNNNNNNNNNNGCAACN | 1051 | TEAD4:RFX5 |
| RCATTCNNNNNNNNNNNNNNNNNNGCAACN | 1052 | TEAD4:RFX5 |
| RCATTCNNNNNTAATKR | 1053 | TEAD4:DLX3 |
| RCATTCYNNNNCAAGGTCAN | 1054 | TEAD4:ESRRB |
| RCATTCYNNNNTAATTR | 1055 | TEAD4:DLX2 |
| RCCGGAANNNNNATCGATN | 1056 | ETV2:ONECUT2 |
| RCCGGAANNNNNNATCGATN | 1057 | ETV2:ONECUT2 |
| RCCGGANNNNNNNNNNNACACCTN | 1058 | ETV2:EOMES |
| RCCGGANNNNNNNNNNNACACCTN | 1059 | ETV2:TBX21 |
| RCCGGANNNNNNNNNNTAATCCN | 1060 | ETV2:GSC2 |
| RCCGGANNNNNNNNNTAATCCN | 1061 | ETV2:GSC2 |
| RCCGGANNNNNNNNTAATCCN | 1062 | ETV2:GSC2 |
| RCCGGAWGTKKN | 1063 | FOXO1:ETV1 |
| RCCGGAWGTKKN | 1064 | FOXO1:ETV4 |
| RCCGGAWGTKKW | 1065 | FOXO1:ELK3 |
| RGAATGCGGAARYNNNTCCN | 1066 | TEAD4:ETV7 |
| RGAATSCGGAAGYN | 1067 | TEAD4:ELK1 |
| RGGTGTNNNNNNNNNGAATGYN | 1068 | TEAD4:EOMES |
| RGGTGYTAATWR | 1069 | ALX4:TBX21 |
| RGTGTNNNAATATKNN | 1070 | POU2F1:EOMES |
| RGWATGTTAATCCS | 1071 | TEAD4:GSC2 |
| RKCACGTGNNNMCATATGKN | 1072 | ARNTL:BHLHA15 |
| RKRNRGGCGGAARCGGAAGNN | 1073 | GCM1:ELK1 |
| RMATWCCGGAWRN | 1074 | TEAD4:ELK1 |
| RNCGGAANNNNNNNNNGCAACN | 1075 | ETV2:RFX5 |
| RNCGGANNTTGCGCAAN | 1076 | FLI1:CEBPB |
| RNCGGANNTTGCGCAAN | 1077 | FLI1:CEBPD |
| RRGTGTNNNNNNNNACAATRN | 1078 | SOX6:TBX21 |
| RSCGGAAATRCM | 1079 | TEAD4:ETV1 |
| RSCGGAAGNNGTAAAN | 1080 | ELK1:HOXB13 |
| RSCGGAAGTNGTAAAN | 1081 | HOXD12:ETV1 |
| RSCGGAANCACGTGN | 1082 | ERF:MAX |
| RSCGGAANCACGTGN | 1083 | FLI1:MAX |
| RSCGGAANNNNNNCACGTGNN | 1084 | ETV2:HES7 |
| RSCGGAANNNNNNNCACGTGNN | 1085 | ETV2:HES7 |
| RSCGGAANNNNNNNTAATKR | 1086 | ETV2:DLX3 |
| RSCGGAANNNNNNNRTCGATN | 1087 | ERF:ONECUT2 |

TABLE 35-continued

Motifs for Binding Sites or Signaling Centers

| Motif Sequence | SEQ ID NO | Complex_name |
| --- | --- | --- |
| RSCGGAANNNNNYAATTAN | 1088 | FLI1:DLX2 |
| RSCGGAANNRYMAACAN | 1089 | ETV2:FOXI1 |
| RSCGGAANRWMAACAN | 1090 | ELK1:FOXI1 |
| RSCGGAARCAGGTGN | 1091 | ETV5:FIGLA |
| RSCGGAARYNNTAAAN | 1092 | HOXB13:ETV1 |
| RSCGGANNCATATGK | 1093 | ETV2:BHLHA15 |
| RSCGGATGTTRTN | 1094 | FOXO1:ELK1 |
| RSCGGAWNNNNNNNACAATRN | 1095 | ETV2:SOX15 |
| RSCGGAWNNNNNNNNACAATRN | 1096 | ETV2:SOX15 |
| RSCGGWAATKR | 1097 | ETV5:EVX1 |
| RSCGGWAATKR | 1098 | ETV5:HOXA2 |
| RSGTGNNNAACGK | 1099 | MYBL1:EOMES |
| RTAAACAYNRTAAAN | 1100 | FOXJ2:HOXB13 |
| RTAAACMGGAARYN | 1101 | ERF:FOXI1 |
| RTAAACMGGAARYN | 1102 | FLI1:FOXI1 |
| RTAAATANGGGNN | 1103 | GCM1:FOXI1 |
| RTAAATANGGGNN | 1104 | GCM2:FOXI1 |
| RTCACGYSNCCGGAWN | 1105 | ETV2:SREBF2 |
| RTGCGGGNAGGTGNNN | 1106 | GCM2:EOMES |
| RTGCGGGNNATCGATR | 1107 | GCM1:ONECUT2 |
| RTGCGGGNNNNNNNNCACGTGN | 1108 | GCM1:MAX |
| RTGCGGGNNNTCGATR | 1109 | GCM1:ONECUT2 |
| RTMAACAGGAAGTN | 1110 | FOXO1:ELK3 |
| RTMAACAGGAAGTN | 1111 | FOXO1:FLI1 |
| RTMAACAGGAARNN | 1112 | ERF:FOXO1 |
| RTMAACAGGAWRN | 1113 | ETV5:FOXO1 |
| RTRCGGGTAATAAAN | 1114 | GCM2:HOXA13 |
| RTRNNGGCGGAAGTN | 1115 | GCM1:ETV1 |
| RTRYGGGCGGAARKN | 1116 | GCM1:ERG |
| RWCACGTGNNCGGAANN | 1117 | ELK1:SREBF2 |
| RWMAACAGGNNNNNNTTCCNN | 1118 | FOXO1:ETV7 |
| SGCGCCNNNNNNNNNNNNNNCAGCTGNN | 1119 | E2F1:NHLH1 |
| SGCGCNNNNNCGGAAGN | 1120 | E2F1:ELK1 |
| SGCGCNNNNNNNNNNCGGAAGN | 1121 | E2F1:ELK1 |
| SGCGCNNNNNNNNNNNCGGAAGN | 1122 | E2F1:ELK1 |
| SGTCACGCNTCATTNN | 1123 | HOXB2:PAX9 |
| SYMATTANNNNNNRGCAACN | 1124 | HOXB2:RFX5 |
| WTGMATAACAATR | 1125 | POU2F1:SOX15 |

TABLE 35-continued

Motifs for Binding Sites or Signaling Centers

| Motif Sequence | SEQ ID NO | Complex_name |
|---|---|---|
| YNATTANRGGTGTGAN | 1126 | MGA:DLX3 |
| NCACGTGNNNNNNNCATWCC | 1127 | TEAD4:CLOCK |
| NCACGTGNNNNNNNNCATWCC | 1128 | TEAD4:CLOCK |
| NCAGCTGNNNNNNNNTRCGGG | 1129 | GCM1:NHLH1 |
| NCAGCTGNNNNNNNNTRCGGG | 1130 | GCM1:NHLH1 |
| NCCGGAANNNNNNNNMATWCC | 1131 | TEAD4:ELK3 |
| NCRCGTGNNNGGATTA | 1132 | PITX1:HES7 |
| NGTGNNNNMATATKNNNACACC | 1133 | POU2F1:TBX21 |
| NNCRCGTGNNNNGGATTA | 1134 | PITX1:HES7 |
| NNMATTAGTCACGCWTSRNTG | 1135 | HOXB2:PAX1 |
| NNMATTAGTCACGCWTSRNTG | 1136 | HOXB2:PAX5 |
| NNMATTAGTCACGCWTSRNTG | 1137 | HOXB2:PAX9 |
| NNNTATGCAGYGTKA | 1138 | POU2F1:EOMES |
| NNTCCCGCNNNCCNNNGGC | 1139 | TFAP2C:E2F8 |
| NSCCNNNRGGCANNNNYMATTA | 1140 | TFAP2C:DLX3 |
| NSCGGACGGAWATCCGSNT | 1141 | ETV2:SPDEF |
| NSCGGANNNNNGGMTTA | 1142 | ERF:PITX1 |
| NSCGGANNNNNNGGMTTA | 1143 | ERF:PITX1 |
| NTRNGGGNNNCACGTG | 1144 | GCM2:MAX |
| NTTTATNRNTMAACA | 1145 | FOXJ2:HOXB13 |
| RCATWCCNNNNNNNNNYNNTAAA | 1146 | TEAD4:HOXA13 |
| RCATWCNNNNGGATTA | 1147 | TEAD4:PITX1 |
| RCATWCNNNNNGGATTA | 1148 | TEAD4:PITX1 |
| RCATWCNNNNNNAGGTCA | 1149 | TEAD4:ESRRB |
| RCATWCYNNNNNTAATCC | 1150 | TEAD4:PITX1 |
| RCATWCYNNNNTAATCC | 1151 | TEAD4:PITX1 |
| RGGTGTKANNNNGGATTA | 1152 | PITX1:EOMES |
| RMATATKCNNNNNNNNNNNNNNNNRWMAACA | 1153 | POU2F1:FOXO6 |
| RMATATKCNNNNNNNNNNNNNNNNRWMAACA | 1154 | POU2F1:FOXO6 |
| RMATATKCNNNNNNNNNNNNNNNNNRWMAACA | 1155 | POU2F1:FOXO6 |
| RNCGGAWGTMATTA | 1156 | ETV5:HOXA2 |
| RSCGGAANNNNNNNNNCATWCC | 1157 | TEAD4:ERG |
| RSCGGAANTSRCGTGA | 1158 | ELK1:SREBF2 |
| RSCGGAASNGRTCGATA | 1159 | ELK1:ONECUT2 |
| RSCGGWAATKNNNNNNNNNMATTA | 1160 | ETV5:HOXA2 |
| RSCGGWANNNNYMATTA | 1161 | ELK1:EVX1 |
| RSMGGAWGYAATTA | 1162 | ETV5:DRGX |
| RTAAACWNATWAAA | 1163 | FOXJ2:HOXB13 |

TABLE 35-continued

Motifs for Binding Sites or Signaling Centers

| Motif Sequence | SEQ ID NO | Complex_name |
|---|---|---|
| RTGNKGGCGGAWG | 1164 | GCM1:SPDEF |
| RTRCGGGNNGATTA | 1165 | GCM2:PITX1 |
| RTRCGGGNNNNTTACGTAA | 1166 | GCM2:TEF |
| RWMAACASYMRTWAAA | 1167 | FOXO1:HOXB13 |
| SCCNNNGGCNNYAATTA | 1168 | TFAP2C:DRGX |
| SYAATTANWGGTGYGA | 1169 | MGA:DLX2 |
| WTWTGCATANNTAATTA | 1170 | POU2F1:DLX2 |
| YNRCACSTCGTWAA | 1171 | HOXD12:TBX21 |
| NAACGGNNATYGANN | 1172 | MYBL1:ONECUT2 |
| NATCGATNNNNNGCCTNNGGSNN | 1173 | TFAP2C:ONECUT2 |
| NATCGATNNNNNNGCCTNNGGSNN | 1174 | TFAP2C:ONECUT2 |
| NATCGATNNNNNNNGCCTNNGGSNN | 1175 | TFAP2C:ONECUT2 |
| NATCRATNNNNNNNAACAATRS | 1176 | CUX1:SOX15 |
| NATCRATNNNNNNNNAACAATRS | 1177 | CUX1:SOX15 |
| NATTTRCNNNACAATRN | 1178 | POU2F1:SOX2 |
| NCACGTGNNYAACSGNN | 1179 | MYBL1:MAX |
| NCAGGTGNGWATGYN | 1180 | TEAD4:TCF3 |
| NCAGSTGNNNNNNNGTAATKR | 1181 | TFAP4:DLX3 |
| NCAGSTGNNNNNNNNGTAATKR | 1182 | TFAP4:DLX3 |
| NCASSTGKNNNNNNNNNCACGTGN | 1183 | CLOCK:FIGLA |
| NCASSTGKNNNNNNNNNNCACGTGN | 1184 | CLOCK:FIGLA |
| NCCGGAAGYNNCNTAGCAACS | 1185 | ETV2:RFX5 |
| NCCGGAANNNNNNCACGYGNN | 1186 | ERF:HES7 |
| NCCGGAANTNRTAAAN | 1187 | FLI1:HOXB13 |
| NCCGGANNCASSTGY | 1188 | FLI1:TCF3 |
| NGATAASNNNRGWATGY | 1189 | TEAD4:GATA3 |
| NGCCTNNGGSNNCGGAAGYN | 1190 | TFAP2C:ELK1 |
| NGGTGTGNNGGCGCSNNNNCRMN | 1191 | E2F3:TBX21 |
| NNCACGTGNNNNRGMTTAN | 1192 | ARNTL:PITX1 |
| NNCAGCTGNNNNNNNNNATYGATN | 1193 | CUX1:NHLH1 |
| NNCGGAWGYMATTAN | 1194 | FLI1:DRGX |
| NNGGAMGGATKTCCGSN | 1195 | ETV5:ETV7 |
| NNGTMAATANGGGYR | 1196 | GCM1:FOXI1 |
| NNGYGNNNNNNNNNWAACAACACNN | 1197 | FOXJ3:TBX21 |
| NNGYGYSACATTCCN | 1198 | TEAD4:EOMES |
| NNMGGAARTGCKGGN | 1199 | GCM1:ELF1 |
| NNMRTAAANTMACACNN | 1200 | HOXB13:EOMES |
| NNNMGGAANNNNNNTCCNNNRCAACN | 1201 | RFX3:ETV7 |

TABLE 35-continued

Motifs for Binding Sites or Signaling Centers

| Motif Sequence | SEQ ID NO | Complex_name |
|---|---|---|
| NNNRTAAANNTNACACYN | 1202 | HOXB13:TBX3 |
| NNNRTAAAWATYGAYY | 1203 | HOXB13:ONECUT2 |
| NNRGYAACNTCACGTGAY | 1204 | RFX3:SREBF2 |
| NRGTGTNANNNNNNNNNNNNNNNNCCGGAANN | 1205 | ERF:TBX21 |
| NRGYAACNNNCATATGKN | 1206 | RFX3:BHLHA15 |
| NRTCRATANCGGAARYN | 1207 | ETV2:ONECUT2 |
| NRTMAACMGGAARYN | 1208 | ETV2:FOXI1 |
| NSCCNNNRGGCANNNNNNTAATKR | 1209 | TFAP2C:DLX3 |
| NSCCNNNRGGCANNNNNTAATKR | 1210 | TFAP2C:DLX3 |
| NTCACACMNNNATCRATN | 1211 | CUX1:TBX21 |
| NTGACAGNTAATCRATAN | 1212 | MEIS2:ONECUT2 |
| NTNNNGGCGGAAGNNNNTTCCNNN | 1213 | GCM1:ETV7 |
| NTRNGGGCGGAAGNNNNTTCCNNN | 1214 | GCM1:ETV7 |
| NTRYGGGNNNTGGCGGGARN | 1215 | GCM2:E2F8 |
| NYMRTAAANATYGATN | 1216 | CUX1:HOXA13 |
| RATTCCNNNNNNNNNNNNCASSTGN | 1217 | TEAD4:FIGLA |
| RCATWCCNNNNNNNNNNNNNNNRWGCGTGACN | 1218 | TEAD4:PAX5 |
| RCATWCCNNNNNNNTTTAYNNN | 1219 | TEAD4:HOXA13 |
| RCCGGAANNNNNNNRATCRATN | 1220 | ETV2:ONECUT2 |
| RCCGGAARCASSTGNN | 1221 | TFAP4:ETV4 |
| RCCGGANRNNCGGWATKN | 1222 | TEAD4:ELK1 |
| RGGTGNTAAKCCN | 1223 | MGA:PITX1 |
| RGGTGNTAATNNNNNNNNNCASYNN | 1224 | ALX4:TBX21 |
| RGWATGYTAATKN | 1225 | TEAD4:DRGX |
| RGWATGYTAATKR | 1226 | TEAD4:DLX2 |
| RNCGGAAGNNNNNCASSTGN | 1227 | ETV5:TCF3 |
| RNCGGAANYNRTWAAN | 1228 | ELK1:HOXB13 |
| RNGTGNNNNNNNNNNNNNNNNRCRCCGGAWSN | 1229 | ETV5:EOMES |
| RRGTGTKNNNNNNNNNNNNNNNCMGGANNN | 1230 | ERF:EOMES |
| RRTCRATNNNCGGAARYN | 1231 | ETV2:ONECUT2 |
| RSCGGAANCAGSTGNN | 1232 | TFAP4:ETV1 |
| RSCGGAANCASCTGNN | 1233 | ERF:FIGLA |
| RSCGGAANCASSTGN | 1234 | FLI1:FIGLA |
| RSCGGAANNNNNNGGMTTAN | 1235 | ETV2:PITX1 |
| RSCGGAASNGRTCGATAN | 1236 | ELK1:ONECUT2 |
| RSCGGANNTTGCGYAAN | 1237 | ETV2:CEBPD |
| RSCGGAWRCASSTGN | 1238 | TFAP4:FLI1 |
| RSCGGWAATNNNNATTAN | 1239 | ETV5:EVX1 |

TABLE 35-continued

Motifs for Binding Sites or Signaling Centers

| Motif Sequence | SEQ ID NO | Complex_name |
|---|---|---|
| RSCGGWAATNNNNNATTAN | 1240 | ETV5:EVX1 |
| RSCGGWAATNNNYATTAN | 1241 | ETV2:EVX1 |
| RSMGGAANTTGCGYAAN | 1242 | ERF:CEBPD |
| RSMGGAARTNNTAAAN | 1243 | HOXB13:ELK1 |
| RTAAACANNNNNATCRATN | 1244 | CUX1:FOXI1 |
| RTAAACANNNNNATCRATN | 1245 | CUX1:FOXO6 |
| RTMAACATRNGGGN | 1246 | GCM1:FOXI1 |
| RTMAATAMGGGYRN | 1247 | GCM1:FOXO1 |
| RTMRCGTGACGGAWGN | 1248 | ETV2:SREBF2 |
| RTRCGGNNNNNNNNYWTTGTNN | 1249 | GCM2:SOX15 |
| RTRCGGNNNNNNTAATKR | 1250 | GCM2:DLX3 |
| RTRCGGNNNNNTAATKR | 1251 | GCM2:DLX3 |
| RTRCGGNNNNNTAATTR | 1252 | GCM2:DLX2 |
| RTRCGGNNNNRNACAAWN | 1253 | GCM2:SOX15 |
| RTRCGGNNNRNACAAWN | 1254 | GCM2:SOX15 |
| RTRCGGGSGATTAN | 1255 | GCM2:PITX1 |
| RTRNGGGTNNTAAAN | 1256 | GCM1:HOXB13 |
| RTRSGGGNAATTAN | 1257 | GCM2:DRGX |
| RTRSGGGNNAATTAN | 1258 | GCM2:DRGX |
| RTRSGGGNNNATTGTKY | 1259 | GCM1:SOX2 |
| RTRSGGGNNTAATKR | 1260 | GCM1:HOXA2 |
| RTRSKGGCGGANNNNNNATCCNNN | 1261 | GCM1:SPDEF |
| RTRSKGGCGGANNNNNNNATCCNNN | 1262 | GCM1:SPDEF |
| SYMRTAAANATYGATN | 1263 | CUX1:HOXB13 |
| SYMRTAAANNNNCASSTGN | 1264 | HOXD12:FIGLA |
| WGTTKMCGGAWRTN | 1265 | ELK1:FOXI1 |
| YNATTAGTCACGCWTSRNTR | 1266 | HOXA3:PAX5 |
| NCASSTGNNNNNNNNNRTRCGGG | 1267 | GCM2:FIGLA |
| NGGTGTGNNNGGCGCSNNNCRC | 1268 | E2F1:EOMES |
| NNCGGANGNNNTWAA | 1269 | ETV5:HOXB13 |
| NNCGGAWGTNRTWAA | 1270 | ETV5:HOXA13 |
| NTATKCAGYGTNA | 1271 | POU2F1:EOMES |
| NTATKCAGYGTNA | 1272 | POU2F1:TBX21 |
| RATCRATNNNNNNNNNNNRGYAAC | 1273 | CUX1:RFX5 |
| RATCRATNNNNNNNNNNRGYAAC | 1274 | CUX1:RFX5 |
| RCATWCCNNNNNNNNNNNNNNNRTMAACA | 1275 | TEAD4:FOXI1 |
| RCATWCCNNNNNNNNNNNNNNNNRTMAACA | 1276 | TEAD4:FOXI1 |
| RCATWCCNNNNNNNNNNNNNNNNNRTMAACA | 1277 | TEAD4:FOXI1 |

TABLE 35-continued

Motifs for Binding Sites or Signaling Centers

| Motif Sequence | SEQ ID NO | Complex_name |
|---|---|---|
| RCATWCCNNNNNNNNNNNNRTMAACA | 1278 | TEAD4:FOXI1 |
| RCATWCYNNNNTAATYRNATTA | 1279 | TEAD4:ALX4 |
| RSCGGAACYACGCWYSANTG | 1280 | ELK1:PAX1 |
| RSCGGAACYACGCWYSANTG | 1281 | ELK1:PAX5 |
| RSCGGAACYACGCWYSANTG | 1282 | ELK1:PAX9 |
| RSCGGAANNAGGYGYNA | 1283 | ELK1:EOMES |
| RSCGGAANNRTMAAYA | 1284 | ELK1:FOXI1 |
| RSCGGAANRTMAAYA | 1285 | ELK1:FOXI1 |
| RTRCGGGNNCASSTG | 1286 | GCM2:FIGLA |
| RWMAACAYCRTWAA | 1287 | FOXO1:HOXA10 |
| SCCNNNNGGCATNGTWAA | 1288 | TFAP2C:HOXB13 |
| NATYGATNNNNNNNNNNGCCTNNGGSNN | 1289 | TFAP2C:ONECUT2 |
| NCASSTGNNNNNNNNCSGTTR | 1290 | MYBL1:FIGLA |
| NCASSTGNNNNNNNNNCSGTTR | 1291 | MYBL1:FIGLA |
| NCASSTGNNNNNNNNNNCSGTTR | 1292 | MYBL1:FIGLA |
| NCASSTGNNNNNNNYAACSGYN | 1293 | MYBL1:FIGLA |
| NCASSTGNNNNNYAACSGYN | 1294 | MYBL1:FIGLA |
| NCCATAYWNGGWNNNNATCRATN | 1295 | CUX1:SRF |
| NGGTGTGNNNNNTMATTWGCRN | 1296 | HOXB2:TBX21 |
| NRGCAACNNNCRCGYGNN | 1297 | RFX3:HES7 |
| NRGYAACNNNNNNCCTWWWNNGGN | 1298 | RFX3:SRF |
| NSCGGANNTTRCGYAAN | 1299 | ETV5:CEBPD |
| NTTRCGYAANNNNNNGGAATGY | 1300 | TEAD4:CEBPB |
| RCATTCCNNCRCGYGYN | 1301 | TEAD4:HES7 |
| RCATTCCNNNNNNCRCGYGYN | 1302 | TEAD4:HES7 |
| RGGTGNGANNNNNNNNNTNNCACCGGAAGY | 1303 | ELK1:EOMES |
| RGGTGTNNNGGCGSNNTNNCRSNN | 1304 | E2F1:EOMES |
| RGTGTKRNNNNNNNNNNNNNCNCMGGAARN | 1305 | ETV2:TBX21 |
| RGWATSCGGATGNNNNTCCKNNN | 1306 | TEAD4:SPDEF |
| RRCRCGYGYNNNNNSGCGCSN | 1307 | E2F1:HES7 |
| RSCGGAANNRTMAAYAN | 1308 | ELK1:FOXI1 |
| RSCGGAWNTTRCGYAAN | 1309 | ETV2:TEF |
| RTGNKGGCGGAWGNNNNNNTCCGGNN | 1310 | GCM1:SPDEF |
| RTGNKGGCGGAWGNNNNNTCCGGNN | 1311 | GCM1 SPDEF |
| RTRCGGGNNNNNNNATCRATN | 1312 | GCM2:ONECUT2 |
| RTRNKGGTNNNGCACGYGNN | 1313 | GCM2:HES7 |
| SCCNNNGGSNNNGGAAGNNNTTCCNN | 1314 | TFAP2C:ETV7 |
| SRCRCGYGSYNNNNSGCGCSN | 1315 | E2F1:HES7 |

TABLE 35-continued

Motifs for Binding Sites or Signaling Centers

| Motif Sequence | SEQ ID NO | Complex_name |
|---|---|---|
| WNGTGYKAMATWCY | 1316 | TEAD4:EOMES |
| MTRSGGGNNNNNNNTTRCGYAAN | 1317 | GCM1:CEBPB |
| MTRSGGGNNNNNNTTRCGYAAN | 1318 | GCM1:CEBPB |
| NGGTGTNNNNNNNNNNNNNNNCACNTNNTWAN | 1319 | HOXD12:TBX21 |
| NGYGYTAAYNNNNNNTNACACNN | 1320 | ALX4:EOMES |
| NNCRCGYGNNNNNNNNSCCNNNGGS | 1321 | TFAP2C:HES7 |
| NNCRCGYGNNNNNNNSCCNNNGGS | 1322 | TFAP2C:HES7 |
| NNGYGNNNNGGCGCSNNNNCRCNN | 1323 | E2F3:EOMES |
| NNNTATGCNNNGYGANNNNNNNNNNNNCRCN | 1324 | POU2F1:EOMES |
| NNSYGNCNAACNNNNNNNCACRCNN | 1325 | MYBL1:EOMES |
| NTTRCGYAANNNNNNNNNRGWATGY | 1326 | TEAD4:CEBPD |
| NTTRCGYAANNNNNNNNRGWATGY | 1327 | TEAD4:CEBPD |
| NTTRCGYAANNNNNNNRGWATGY | 1328 | TEAD4:CEBPD |
| RGGTGWKNNNNNNNNNNNTNNCRTRNGGGN | 1329 | GCM1:TBX21 |
| RGWATGYNNTTRCGYAAN | 1330 | TEAD4:CEBPD |
| NGYGNNAMATWCYNNTMRCRCN | 1331 | TEAD4:EOMES |

TABLE 36

Gene Complex Motif Patterns

| Pattern | Number of each pattern in Gene Complex Table |
|---|---|
| AB | 11 |
| ABA | 27 |
| ABAB | 29 |
| ABABA | 25 |
| ABABAB | 23 |
| ABABABA | 5 |
| ABABABAB | 11 |
| ABABABABA | 1 |
| ABABABABAB | 6 |
| ABABABABABA | 1 |

TABLE 37

Gene Complex Motif Patterns

| Pattern | Number of each pattern in Gene Complex Table |
|---|---|
| BA | 6 |
| BAB | 46 |
| BABA | 58 |
| BABAB | 155 |
| BABABA | 45 |
| BABABAB | 95 |
| BABABABA | 22 |
| BABABABAB | 28 |
| BABABABABAB | 14 |
| BABABABABABABAB | 1 |

TABLE 38

Single Gene Motif Patterns

| Pattern | Number of each pattern in Single Gene Table |
|---|---|
| AB | 42 |
| ABA | 97 |
| ABAB | 37 |
| ABABA | 40 |
| ABABAB | 4 |
| ABABABA | 28 |
| ABABABAB | 4 |
| ABABABABA | 4 |
| ABABABABABA | 1 |

TABLE 39

Single Gene Motif Patterns

| Pattern | Number of each pattern in Single Gene Table |
|---|---|
| BA | 34 |
| BAB | 186 |
| BABA | 40 |
| BABAB | 120 |
| BABABA | 15 |
| BABABAB | 47 |
| BABABABA | 8 |
| BABABABAB | 8 |
| BABABABABA | 1 |
| BABABABABAB | 2 |

TABLE 40

IUPAC Nucleotide Code

| IUPAC code | Base |
|---|---|
| A | Adenine |
| C | Cytosine |
| G | Guanine |
| T (or U) | Thymine (or Uracil) |
| R | A or G |
| Y | C or T |
| S | G or C |
| W | A or T |
| K | G or T |
| M | A or C |
| B | C or G or T |
| D | A or G or T |
| H | A or C or T |
| V | A or C or G |
| N | Any base |
| "." or "—" | gap |

TABLE 41

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 1 | | | c.-366A>G | | Regulatory | |
| 2 | Exon 1 | 1 | c.1A>G | p.Met1Val | Missense | |
| 3 | | 1 | c.1A>T | p.Met1Leu | Missense | |
| 4 | | 1 | c.2T>C | p.Met1Thr | Missense | |
| 5 | | 1 | c.3G>A | p.Met1Ile | Missense | |
| 6 | | 9 | c.25T>G | p.Leu9* | Nonsense | |
| 7 | | 10, 11 | c.28_31del AACA | p.Asn10_Asn11 | Frameshift | |
| 8 | | 10 | c.29dupA | p.fsX | Frameshift | |
| 9 | | 14 | c.40delT | p.Phe14Leufs | Frameshift | |
| 10 | | 18 | c.53delA | p.His18Profs | Frameshift | |
| 11 | | 23 | c.67C>T | p.Arg23* | Nonsense | |
| 12 | | 26 | c.77G>A | p.Arg26Gln | Missense | 0% |
| 13 | | 26 | c.77G>C | p.Arg26Pro | Missense | |
| 14 | Intron 1 | | c.77+1G>T | | Splice site error | |
| 15 | | | c.77+1G>A | | Splice site error | |
| 16 | | | c.77+2dupT | | Splice site error | |
| 17 | | | c.77+3_6del AAGT | | Splice site error | |
| 18 | | | c.77+4A>C | | Splice site error | 0% |
| 19 | | | c.77+5G>A | | Splice site error | |
| 20 | | | c.78-3C>G | | Splice site error | <5% |
| 21 | | | c.78-1G>C | | Splice site error | |
| 22 | Exon 2 | 32 | c.94C>T | p.Gln32* | Nonsense | |
| 23 | | 36 | c.106C>T | p.Gln36* | Nonsense | |
| 24 | | 39 | c.115G>T | p.Gly39Cys | Missense | |
| 25 | | 39 | c.116G>A | p.Gly39Asp | Missense | |
| 26 | | 40 | c.118C>T | p.Arg40Cys | Missense | |
| 27 | | 40 | c.119G>A | p.Arg40His | Missense | 6% |
| 28 | | 40 | c.119G>T | p.Arg40Leu | Missense | |
| 29 | | 41 | c.122A>G | p.Asp41Gly | Missense | |
| 30 | | 43 | c.126_128del TCT | p.Leu43del | In frame indel | |
| 31 | | 43 | c.127C>T | p.Leu43Phe | Missense | |
| 32 | | 44 | c.131C>T | p.Thr44Ile | Missense | |
| 33 | | 45 | c.133C>G | p.Leu45Val | Missense | |
| 34 | | 45 | c.134T>C | p.Leu45Pro | Missense | |
| 35 | | 45 | c.135dupA | p.fsX | Frameshift | |
| 36 | | 45-47 | c.135delA | p.Asn47Thrfs | Frameshift | 0% |
| 37 | | 47 | c.140_141ins G | p.Asn47delinsLysLeufs | Frameshift | |
| 38 | | 47 | c.140A>T | p.Asn47Ile | Missense | |
| 39 | | 47 | c.140A>C | p.Asn47Thr | Missense | |
| 40 | | 48 | c.143T>C | p.Phe48Ser | Missense | |
| 41 | | 49 | c.145A>C | p.Thr49Pro | Missense | |
| 42 | | 50 | c.148G>A | p.Gly50Arg | Missense | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 43 | | 50 | c.148G>T | p.Gly50* | Nonsense | |
| 44 | | 52 | c.154G>A | p.Glu52Lys | Missense | |
| 45 | | 52 | c.154G>T | p.Glu52* | Nonsense | |
| 46 | | 52 | c.155A>G | p.Glu52Gly | Missense | |
| 47 | | 52 | c.156A>T | p.Glu52Asp | Missense | 4% |
| 48 | | 53 | c.158T>C | p.Ile53Thr | Missense | |
| 49 | | 53 | c.158T>G | p.Ile53Ser | Missense | |
| 50 | | 55 | c.163T>G | p.Tyr55Asp | Missense | 28% |
| 51 | | 56 | c.167T>C | p.Met56Thr | Missense | [54%] |
| 52 | | 57 | c.170T>A | p.Leu57Gln | Missense | |
| 53 | | 58 | c.174G>A | p.Trp58* | Nonsense | |
| 54 | | 59 | c.176T>G | p.Leu59Arg | Missense | |
| 55 | | 60 | c.179C>T | p.Ser60Leu | Missense | |
| 56 | | 62 | c.184G>C | p.Asp62His | Missense | |
| 57 | | 62 | c.185A>G | p.Asp62Gly | Missense | |
| 58 | | 63 | c.188T>C | p.Leu63Pro | Missense | |
| 59 | | 67 | c.200T>G | p.Ile67Arg | Missense | |
| 60 | | 69 | c.205C>T | p.Gln69* | Nonsense | |
| 61 | Intron 2 | | c.216+1G>A | | Splice site error | |
| 62 | | | c.216+1G>T | | Splice site error | 10% |
| 63 | | | c.217−1G>A | | Splice site error | |
| 64 | Exon 3 | 73 | c.219T>G | p.Tyr73* | Nonsense | |
| 65 | | 76 | c.227T>C | p.Leu76Ser | Missense | |
| 66 | | 77 | c.231G>T | p.Leu77Phe | Missense | [35%] |
| 67 | | 78 | c.232C>T | p.Gln78* | Nonsense | |
| 68 | | 79 | c.236G>A | p.Gly79Glu | Missense | 0% |
| 69 | | 80 | c.238A>G | p.Lys80Glu | Missense | |
| 70 | | 80 | c.240G>T | p.Lys80Asn | Missense | |
| 71 | | 81-82 | c.243_245delCTT | p.Leu244del | In frame indel | |
| 72 | | 82 | c.245T>G | p.Leu82* | Nonsense | |
| 73 | | 82 | c.245T>A | p.Leu82* | Nonsense | |
| 74 | | 83 | c.248G>A | p.Gly83Asp | Missense | |
| 75 | | 85 | c.256dupT | p.fsX | Frameshift | |
| 76 | | 88 | c.264A>T | p.Lys88Asn | Missense | 3% |
| 77 | | 90 | c.268A>G | p.Ser90Gly | Missense | (<20%) |
| 78 | | 90 | c.269G>A | p.Ser90Asn | Missense | |
| 79 | | 90 | c.270T>G | p.Ser90Arg | Missense | |
| 80 | | 91 | c.271delA | p.Thr91Leufs | Frameshift | |
| 81 | | 92 | c.274C>G | p.Arg92Gly | Missense | |
| 82 | | 92 | c.274C>T | p.Arg92* | Nonsense | 0% |
| 83 | | 92 | c.275G>T | p.Arg92Leu | Missense | |
| 84 | | 92 | c.275G>A | p.Arg92Gln | Missense | 0% |
| 85 | | 92 | c.275G>C | p.Arg92Pro | Missense | |
| 86 | | 93 | c.277A>G | p.Thr93Ala | Missense | |
| 87 | | 94 | c.281G>C | p.Arg94Thr | Missense | |
| 88 | | 95 | c.284T>C | p.Leu95Ser | Missense | |
| 89 | | 98 | c.292G>A | p.Glu98Lys | Missense | 33% |
| 90 | Intron 3 | | c.298+1G>A | | Splice site error | |
| 91 | | | c.298+1G>T | | Splice site error | |
| 92 | | | c.298+1_5delGTAAG | | Splice site error | |
| 93 | | | c.298+5G>C | | Splice site error | |
| 94 | | | c 299−8T>A | | Splice site error | |
| 95 | | | c.299−7A>G | | Splice site error | |
| 96 | Exon 4 | 100 | c.299G>A | p.Gly100Asp | Missense | |
| 97 | | 100 | c.298G>C | p.Gly100Arg | Missense | |
| 98 | | 102 | c.304G>C | p.Ala102Pro | Missense | |
| 99 | | 102 | c.305C>A | p.Ala102Glu | Missense | |
| 100 | | 105 | c.314G>T | p.Gly105Val | Missense | |
| 101 | | 105 | c.314G>A | p.Gly105Glu | Missense | |
| 102 | | 106 | c.316G>A | p.Gly106Arg | Missense | |
| 103 | | 106 | c.317G>A | p.Gly106Glu | Missense | <20% |
| 104 | | 106 | c.317G>T | p.Gly106Val | Missense | |
| 105 | | 109 | c.327T>C | p.Cys109Arg | Missense | |
| 106 | | 109-110 | c.327delT | p.Cys109Cysfsx | Frameshift | |
| 107 | | | c.341-342delAA | p.fsX | Frameshift | |
| 108 | | 111 | c.332T>C | p.Leu111Pro | Missense | |
| 109 | | 117 | c.350A>G | p.His117Arg | Missense | 18% |
| 110 | | 117 | c.350A>T | p.His117Leu | Missense | |
| 111 | | 120 | c.358_359delGT | p.Val120Glufs | Frameshift | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 112 | | 122 | c.364_365insTT | p.Glu122delinsValLysfs | Frameshift | |
| 113 | | 125 | c.374C>T | p.Thr125Met | Missense | <1% |
| 114 | | 125 | c.375delG | p.Thr125Thrfs | Frameshift | |
| 115 | | 126 | c.377A>G | p.Asp126Gly | Missense | |
| 116 | | 129 | c.386G>C | p.Arg129Pro | Splice site error | |
| 117 | | 129 | c.386G>A | p.Arg129His | Splice site error | 3.50% |
| 118 | | 129 | c.386G>T | p.Arg129Leu | Splice site error | |
| 119 | | 129 | c.385C>T | p.Arg129Cys | Splice site error | |
| 120 | Intron 4 | | c.386+1G>T | | Splice site error | |
| 121 | | | c.386+1G>A | | Splice site error | |
| 122 | | | c.386+1G>C | | Splice site error | |
| 123 | | | c.386+2T>C | | Splice site error | |
| 124 | | | c.386+5G>A | | Splice site error | |
| 125 | | | c.387−2A>T | | Splice site error | |
| 126 | | | c.387−2A>C | | Splice site error | |
| 127 | | | c.387−2A>G | | Splice site error | |
| 128 | Exon 5 | 130-131 | c.390_391insTTA | p.Val130_Leu131insLeu | In frame indel | |
| 129 | | 131 | c.392T>C | p.Leu131Ser | Missense | |
| 130 | | 132 | c.394T>C | p.Ser132Pro | Missense | |
| 131 | | 132 | c.395C>T | p.Ser132Phe | Missense | [78.6%] |
| 132 | | 135 | c.403delG | p.Ala135Glnfs | Frameshift | |
| 133 | | 135 | c.404C>A | p.Ala135Glu | Missense | |
| 134 | | 136 | c.407A>T | p.Asp136Val | Missense | |
| 135 | | 137 | c.409G>C | p.Ala137Pro | Missense | |
| 136 | | 137 | c.409G>A | p.Ala137Thr | Missense | |
| 137 | | 139 | c.416T>C | p.Leu139Ser | Missense | |
| 138 | | 140 | c.418G>C | p.Ala140Pro | Missense | |
| 139 | | 140 | c.419C>A | p.Ala140Asp | Missense | |
| 140 | | 141 | c.421C>G | p.Arg141Gly | Missense | |
| 141 | | 141 | c.421C>T | p.Arg141* | Nonsense | |
| 142 | | 141 | c.422G>A | p.Arg141Gln | Missense | 0% |
| 143 | | 141 | c.422G>C | p.Arg141Pro | Missense | |
| 144 | | 142 | c.425T>A | p.Val142Glu | Missense | |
| 145 | | 143 | c.429T>A | p.Tyr143* | Nonsense | |
| 146 | | 144 | c.430A>T | p.Lys144* | Nonsense | |
| 147 | | 146 | c.437C>G | p.Ser146* | Nonsense | |
| 148 | | 148 | c.443T>C | p.Leu148Ser | Missense | |
| 149 | | 148 | c.443T>G | p.Leu148Trp | Missense | |
| 150 | | 148 | c.444G>C | p.Leu148Phe | Missense | |
| 151 | | 148 | c.444G>T | p.Leu148Phe | Missense | 17% |
| 152 | | 150-151 | c.449delC | p.fsX | Frameshift | |
| 153 | | 151 | c.452T>G | p.Leu151Arg | Missense | |
| 154 | | 152 | c.455C>T | p.Ala152Val | Missense | 3.70% |
| 155 | | 154 | c.460G>T | p.Glu154* | Nonsense | 0% |
| 156 | | 154 | c.461_471del | p.Glu154Alafs*18 | Frameshift | |
| 157 | | 155 | c.463G>T | p.Ala155Ser | Missense | |
| 158 | | 155 | c.463G>C | p.Ala155Pro | Missense | |
| 159 | | 155 | c.464C>A | p.Ala155Glu | Missense | |
| 160 | | 158 | c.472C>T | p.Pro158Ser | Missense | |
| 161 | | 159 | c.476T>C | p.Ile159Thr | Missense | 1.50% |
| 162 | | 159 | c.477T>G | p.Ile159Met | Missense | |
| 163 | | 160 | c.479T>G | p.Ile160Ser | Missense | |
| 164 | | 160 | c.479T>A | p.Ile160Asn | Missense | |
| 165 | | 160 | c.479T>C | p.Ile160Thr | Missense | |
| 166 | | 161 | c.481A>G | p.Asn161Asp | Missense | |
| 167 | | 161 | c.482A>G | p.Asn161Ser | Missense | |
| 168 | | 161 | c.483T>A | p.Asn161Lys | Missense | <10% |
| 169 | | 161 | c.483T>G | p.Asn161Lys | Missense | <10% |
| 170 | | 162 | c.484G>C | p.Gly162Arg | Missense | |
| 171 | | 162 | c.484G>A | p.Gly162Arg | Missense | |
| 172 | | 162 | c.485G>A | p.Gly162Glu | Missense | |
| 173 | | 164 | c.490T>C | p.Ser164Pro | Missense | |
| 174 | | 164 | c.491C>G | p.Ser164* | Nonsense | |
| 175 | | 165 | c.493G>T | p.Asp165Tyr | Missense | |
| 176 | | 167 | c.501C>A | p.Tyr167* | Nonsense | 0% |
| 177 | | 167 | c.501C>G | p.Tyr167* | Nonsense | |
| 178 | | 168 | c.503A>C | p.His168Pro | Missense | |
| 179 | | 168 | c.503A>G | p.His168Arg | Missense | |
| 180 | | 168 | c.504T>A | p.His168Gln | Missense | [69%] |
| 181 | | 169 | c.505C>G | p.Pro169Ala | Missense | |
| 182 | | 169 | c.506C>T | p.Pro169Leu | Missense | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 183 | | 169 | c.506C>A | p.Pro169His | Missense | |
| 184 | | 172 | c.514A>T | p.Ile172Phe | Missense | |
| 185 | | 172 | c.516C>G | p.Ile172Met | Missense | |
| 186 | | 172 | c.515T>A | p.Ile172Asn | Missense | |
| 187 | | 174 | c.520G>C | p.Ala174Pro | Missense | |
| 188 | | 175 | c.524A>G | p.Asp175Gly | Missense | |
| 189 | | 175 | c.524A>T | p.Asp175Val | Missense | |
| 190 | | 176 | c.526T>C | p.Tyr176His | Missense | |
| 191 | | 176 | c.527A>G | p.Tyr176Cys | Missense | 19% |
| 192 | | 176 | c.527A>C | p.Tyr176Leu | Missense | |
| 193 | | 178 | c.533C>T | p.Thr178Met | Missense | |
| 194 | | 177-178 | c.530_533 dupTCAC | p.fsX | Frameshift | |
| 195 | | 178-179 | c.532_537del ACGCTC | p.Thr178_Leu179del | In frame indel | |
| 196 | | 179 | c.535C>T | p.Leu179Phe | Missense | |
| 197 | | 179 | c.536T>C | p.Leu179Pro | Missense | |
| 198 | | 180 | c.538C>T | p.Gln180* | Nonsense | |
| 199 | | 180 | c.[539A>C(+)540G>C] | p.Gln180Pro | Missense | <10% |
| 200 | | 180 | c.540G>C | p.Gln180His | Splice site error | 7.1% [43%] |
| 201 | Intron 5 | | c.540+1G>C | | Splice site error | |
| 202 | | | c.540+2T>C | | Splice site error | 0% |
| 203 | | | c.540+2T>A | | Splice site error | |
| 204 | | | c.541−2A>G | | Splice site error | |
| 205 | | | c.540+265 G>A | | Splice site error | |
| 206 | | | c.540+2T>G | | Splice site error | |
| 207 | Exon 6 | 181 | c.542A>G | p.Glu181Gly | Missense | |
| 208 | | 182 | c.545A>T | p.His182Leu | Missense | |
| 209 | | 183 | c.547T>G | p.Tyr183Asp | Missense | |
| 210 | | 183 | c.548A>G | p.Tyr183Cys | Missense | |
| 211 | | 186 | c.557T>C | p.Leu186Pro | Missense | |
| 212 | | 188 | c 561delA | p.Gln188fs | Frameshift | |
| 213 | | 188 | c.562G>C | p.Gly188Arg | Missense | 2% |
| 214 | | 188 | c.562_563delGG | p.Gly188SfsX36 | Frameshift | |
| 215 | | 188 | c.563G>T | p.Gly188Val | Missense | |
| 216 | | 188 | c.563G>C | p.Gly188Ala | Missense | |
| 217 | | 190 | c.568delA | p.T190PfsX16 | Frameshift | |
| 218 | | 191 | c.571C>T | p.Leu191Phe | Missense | 5.70% |
| 219 | | 191 | c.571delC | p.Leu191SerfsX15 | Frameshift | |
| 220 | | 191 | c.572T>G | p.Leu191Arg | Missense | |
| 221 | | 192 | c.576C>G | p.Ser192Arg | Missense | |
| 222 | | 193 | c.577T>C | p.Trp193Arg | Missense | |
| 223 | | 193 | c.577T>G | p.Trp193Gly | Missense | |
| 224 | | 193 | c.578G>A | p.Trp193* | Nonsense | |
| 225 | | 193 | c.579G>C | p.Trp193Cys | Missense | |
| 226 | | 194 | c.581T>C | p.Ile194Thr | Missense | |
| 227 | | 195 | c.583G>A | p.Gly195Arg | Missense | 0% |
| 228 | | 195 | c.583delG | p.Asp196Metfs | Frameshift | |
| 229 | | 196 | c.586G>A | p.Asp196Asn | Missense | |
| 230 | | 196 | c.586G>T | p.Asp196Tyr | Missense | |
| 231 | | 196 | c.586G>C | p.Asp196His | Missense | |
| 232 | | 196 | c.587A>T | p.Asp196Val | Missense | 7% |
| 233 | | 197 | c.589G>A | p.Gly197Arg | Missense | |
| 234 | | 197 | c.590G>A | p.Gly197Glu | Missense | |
| 235 | | 197 | c.589G>T | p.Gly197Trp | Missense | |
| 236 | | 198 | c.593A>T | p.Asn198Ile | Missense | |
| 237 | | 198 | c.594C>A | p.Asn198Lys | Missense | |
| 238 | | 199 | c.595A>G | p.Asn199Asp | Missense | |
| 239 | | 199 | c.596A>G | p.Asn199Ser | Missense | |
| 240 | | 199-200 | c.(597_598) delTA | p.fsX | Frameshift | |
| 241 | | 201 | c.602T>C | p.Leu201Pro | Missense | |
| 242 | | 202 | c.604C>T | p.His202Tyr | Missense | [49%] |
| 243 | | 202 | c.605A>C | p.His202Pro | Missense | |
| 244 | | 203 | c.608C>G | p.Ser203Cys | Missense | |
| 245 | | 205 | c.613A>G | p.Met205Val | Missense | |
| 246 | | 205 | c.614T>C | p.Met205Thr | Missense | |
| 247 | | 206 | c.617T>G | p.Met206Arg | Missense | |
| 248 | | 206 | c.618G>C | p.Met206Ile | Missense | |
| 249 | | 207 | c.620G>A | p.Ser207Asn | Missense | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 250 | | 207 | c.621C>A | p.Ser207Arg | Missense | |
| 251 | | 208 | c.622G>A | p.Ala208Thr | Missense | 4% |
| 252 | | 209 | c.626C>T | p.Ala209Val | Missense | 1% [1.4%] |
| 253 | | 210 | c.628A>C | p.Lys210Glu | Missense | |
| 254 | | 210 | c.630A>C | p.Lys210Asn | Missense | |
| 255 | | 210 | c.628A>C | p.Lys210Gln | Missense | 0% |
| 256 | | 213 | c.637T>A | p.Met213Lys | Missense | |
| 257 | | 213 | c.637T>C | p.Met213Thr | Misseuse | |
| 258 | | 213 | c.637T>G | p.Met213Arg | Missense | |
| 259 | | 214 | c.640C>T | p.His214Tyr | Missense | |
| 260 | | 215 | c.643C>T | p.Leu215Phe | Missense | 17% |
| 261 | | 215-216 | c.645_646insT | p.Gln216delinsSerGlyfs | Frameshift | |
| 262 | | 216 | c.646C>G | p.Gln216Glu | Missense | |
| 263 | | 217 | c.650C>A | p.Ala217Glu | Missense | |
| 264 | | 218 | c.653C>T | p.Ala218Val | Missense | |
| 265 | | 220 | c.658C>G | p.Pro220Ala | Missense | 35% |
| 266 | | 220 | c.659C>T | p.Pro220Leu | Missense | |
| 267 | | 221 | c.663G>C | p.Lys221Asn | Missense | |
| 268 | | 221 | c.663G>A | p.Lys221Lys | Splice site error | 8% |
| 269 | Intron 6 | | c.663+1G>A | | Splice site error | |
| 270 | | | c.663+1G>T | | Splice site error | |
| 271 | | | c.663+1delG | | Splice site error | |
| 272 | | | c.663+2T>C | | Splice site error | |
| 273 | | | c.663+2dupT | | Splice site error | |
| 274 | | | c.664−1G>A | | Splice site error | |
| 275 | | | c.664−1delG | p.fsX | Frameshift | |
| 276 | Exon 7 | 222 | c.664-667delinsAC | p.Gly222Thrfs*2 | Frameshift | |
| 277 | | 224 | c.670G>T | p.Glu224* | Nonsense | |
| 278 | | 225 | c.673C>A | p.Pro225Thr | Missense | [42%] |
| 279 | | 225 | c.674C>G | p.Pro225Arg | Missense | 0% |
| 280 | | 225 | c.674C>T | p.Pro225Leu | Missense | 0% [0.45%] |
| 281 | | 233 | c.698C>T | p.Ala233Val | Missense | |
| 282 | | 234 | c.700G>T | p.Glu234* | Nonsense | |
| 283 | | 239 | c.716A>T | p.Glu239Val | Missense | |
| 284 | | 239 | c.716A>G | p.Glu239Gly | Missense | |
| 285 | | 239 | c.717G>C | p.Glu239Asp | Missense | |
| 286 | | 239 | c.717G>A | p.Glu239Glu | Splice site error | |
| 287 | Intron 7 | | c.717+1G>T | | Splice site error | |
| 288 | | | c.717+1G>A | | Splice site error | |
| 289 | | | c.717+2T>C | | Splice site error | |
| 290 | | | c.717+3A>G | | Splice site error | |
| 291 | | | c.717+7_22 delTCTTTACATGTAAAGC (SEQ ID NO: 1332) | | Splice site error | 0-1.5% |
| 292 | | | c.718−2A>G | | Splice site error | |
| 293 | Exon 8 | | c.718-4_729delCTAGAATGGTACCAAG (SEQ ID NO: 1333) | | Splice site error | |
| 294 | | 242 | c.725C>T | p.Thr242Ile | Missense | |
| 295 | | 244 | c.731T>A | p.Leu244Gln | Missense | 8% |
| 296 | | 247 | c.740C>A | p.Thr247Lys | Missense | 0% |
| 297 | | 244-247 | c.731_739delTGTTGCTGA | | In frame indel | |
| 298 | | 249 | c.746A>G | p.Asp249Gly | Missense | |
| 299 | | 250 | c.749C>T | p.Pro250Leu | Missense | |
| 300 | | 253 | c.757G>A | p.Ala253Thr | Missense | |
| 301 | | 253 | c.757G>C | p.Ala253Pro | Missense | |
| 302 | | 253 | c.759delA | p.fsX | Frameshift | |
| 303 | | 254 | c.760A>T | p.Ala254* | Nonsense | |
| 304 | | 255 | c.764A>C | p.His255Pro | Missense | |
| 305 | | 260 | c.779T>C | p.Leu260Ser | Missense | |
| 306 | | 262 | c.784_792dup9 | p.thr262_Thr264dupTDT | In frame indel | |
| 307 | | 262 | c.785C>A | p.Thr262Lys | Missense | 26% |
| 308 | | 262 | c.785C>T | p.Thr262Ile | Missense | |
| 309 | | 263 | c.787G>A | p.Asp263Asn | Missense | |
| 310 | | 263 | c.788A>G | p.Asp263Gly | Missense | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 311 | | 264 | c.790A>G | p.Thr264Ala | Missense | 22% |
| 312 | | 264 | c.791C>A | p.Thr264Asn | Missense | |
| 313 | | 264 | c.791C>T | p.Thr264Ile | Missense | |
| 314 | | 265 | c.793T>C | p.Trp265Arg | Missense | |
| 315 | | 265 | c.794G>T | p.Trp265Leu | Missense | 56% |
| 316 | | 265 | c.795G>A | p.Trp265* | Nonsense | |
| 317 | | 265-268 | c.796_805del | p.Ile265_Gly268delins AspfsX19 | Frameshift | |
| 318 | | 267 | c.799A>C | p.Ser267Arg | Missense | |
| 319 | | 268 | c.803T>C | p.Met268Thr | Missense | 6.70% |
| 320 | | 268 | c.802A>G | p.Met268Val | Missense | |
| 321 | | 269 | c.806G>A | p.Gly269Glu | Missense | 2% |
| 322 | | 270 | c.808C>T | p.Gln270* | Nonsense | |
| 323 | | 270 | c.809A>C | p.Gln270Pro | Missense | |
| 324 | | 271-272 | c.810_811del AGinsC | p.fsX | Frameshift | |
| 325 | | 272-273 | c.817_819del GAG | p.Glu273del | In frame indel | 5% |
| 326 | | 273 | c.818delA | p.Glu273Glyfs | Frameshift | |
| 327 | | 277 | c.829C>T | p.Arg277Trp | Missense | 5% [59%] |
| 328 | | 277 | c.830G>A | p.Arg277Gln | Missense | 7% |
| 329 | | 277 | c.830G>T | p.Arg277Leu | Missense | |
| 330 | | 279 | c.835C>T | p.Gln279* | Nonsense | |
| 331 | | 281 | c.842T>C | p.Phe281Ser | Missense | |
| 332 | | 284 | c.853delC | p.Phe284fsX38 | Frameshift | |
| 333 | | 285 | c.853C>T | p.Gln285* | Nonsense | |
| 334 | | 287 | c.860A>C | p.Thr287Pro | Missense | |
| 335 | | 287 | c.861insAC | p.fsX | Frameshift | |
| 336 | | 286-289 | c.867G>A r.856_867del GTTACAAT GAG (SEQ ID NO: 1334) | p.Val286_Lys289del | In frame indel | |
| 337 | | 289 | c.867G>C | p.Lys289Asp | Missense | |
| 338 | | 289 | c.867G>T | p.Lys289Asn | Missense | 0% |
| 339 | Intron 8 | | c.867+1G>A | | Splice site error | |
| 340 | | | c.867+1G>T | | Splice site error | |
| 341 | | | c.867+1126A>G | | Splice site error | |
| 342 | | | c.868−3T>C | | Splice site error | |
| 343 | Exon 9 | 292 | c.875delA | p.Val293Leufs | Frameshift | |
| 344 | | 294 | c.882delT | p.Ala295Profs | Frameshift | |
| 345 | | 297 | c.889G>T | p.Aso297Tyr | Missense | |
| 346 | | 297-298 | c.889_892del GACT | p.fsX | Frameshift | 0% |
| 347 | | 298 | c.892_893del TG | p.Trp298Aspfs | Frameshift | |
| 348 | | 298 | c.892T>C | p.Trip298Arg | Missense | |
| 349 | | 298 | c.893G>C | p.Trp298Ser | Missense | 0% |
| 350 | | 301 | c.902T>C | p.Leu301Ser | Missense | |
| 351 | | 301 | c.903A>T | p.Leu301Phe | Missense | 3% |
| 352 | | 302 | c.904C>T | p.His302Tyr | Missense | 0% |
| 353 | | 302 | c.905A>G | p.His302Arg | Missense | |
| 354 | | 302 | c.905A>T | p.His302Leu | Missense | |
| 355 | | 302 | c.906C>G | p.His302Gln | Missense | |
| 356 | | 302 | c.906delC | p.Cys303Alafs | Frameshift | |
| 357 | | 303 | c.907T>C | p.Cys303Arg | Missense | |
| 358 | | 303 | c.907T>G | p.Cys303Gly | Missense | |
| 359 | | 303 | c.908G>A | p.Cys303Tyr | Missense | |
| 360 | | 304 | c.912G>T | p.Leu304Phe | Missense | 6% [74%] |
| 361 | | 305 | c.914C>G | p.Pro305Arg | Missense | |
| 362 | | 305 | c.914C>A | p.Pro305His | Missense | |
| 363 | | 306 | c.916A>T | p.Arg306* | Nonsense | |
| 364 | | 306 | c.917G>C | p.Arg306Thr | Missense | |
| 365 | | 309-310 | c.(925-927)delGAA | p.Glu309del | In frame indel | |
| 366 | | 310 | c.928G>T | p.Glu310* | Nonsense | |
| 367 | | 310 | c.929_931del AAG | p.Glu310del | In frame indel | |
| 368 | | 310 | c.929A>G | p.Glu310Gly | Missense | |
| 369 | | 311 | c.931G>A | p.Val311Met | Missense | |
| 370 | | 311 | c.932T>A | p.Val311Glu | Missense | |
| 371 | | 314 | c.940_942del GAA | p.Glu314del | In frame indel | |

TABLE 41-continued

Mutations in the OTC gene associated with OTC deficiency

| No. | Exon | Codon[1] | Nucleotide change[2] | Amino acid or other change | Function | % Enzyme activity/[%] N ammonia incorporation[3] |
|---|---|---|---|---|---|---|
| 372 | | 315 | c.943G>T | p.Val315Phe | Missense | |
| 373 | | 315 | c.944T>A | p.Val315Asp | Missense | |
| 374 | | 315 | c.944T>G | p.Val315Gly | Missense | |
| 375 | | 316 | c.947T>C | p.Phe316Ser | Missense | |
| 376 | | 318 | c.953C>T | p.Ser318Phe | Missense | |
| 377 | | 320 | c.958C>T | p.Arg320* | Nonsense | 10-15% |
| 378 | | 320 | c.959G>T | p.Arg320Leu | Missense | [3.9%] |
| 379 | | 321 | c.962C>A | p.Ser321* | Nonsense | |
| 380 | | 322 | c.964C>G | p.Leu322Val | Missense | |
| 381 | | 322 | c.965T>C | p.Leu322Pro | Missense | |
| 382 | | 323 | c.967G>A | p.Val323Met | Missense | |
| 383 | | 326 | c.976G>A | p.Glu326Lys | Missense | |
| 384 | | 328 | c.982G>T | p.Glu328* | Nonsense | |
| 385 | | 330 | c.988A>T; 989_990delGA | p.fsX | Frameshift | |
| 386 | | 330 | c.988A>G | p.Arg330Gly | Missense | |
| 387 | | 331 | c.991A>T | p.Lys331* | Nonsense | |
| 388 | | 332 | c.994T>A | p.Trp332Arg | Missense | 0% |
| 389 | | 332 | c.995G>A | p.Trp332* | Nonsense | |
| 390 | | 332 | c.996G>A | p.Trp332* | Nonsense | |
| 391 | | 332 | c.995G>C | p.Trp332Ser | Missense | |
| 392 | | 335 | c.1005G>A | p.Met335Ile | Missense | |
| 393 | Intron 9 | | c.1005+1G>T | | Splice site error | |
| 394 | | | c.1005+2T>C | | Splice site error | |
| 395 | | | c.1006−3C>G | | Splice site error | 2.70% |
| 396 | | | c.1006−1G>A | | Splice site error | [23%] |
| 397 | | | c.1005_1091 C>G | | Splice site error | |
| 398 | Exon 10 | 336 | c.1006G>T | p.Ala336Ser | Missense | |
| 399 | | 337 | c.1009G>C | p.Val337Leu | Missense | [5%] |
| 400 | | 339 | c.1015G>C | p.Val339Leu | Missense | |
| 401 | | 339 | c.1016T>G | p.Val339Gly | Missense | |
| 402 | | 340 | c.1018T>C | p.Ser340Pro | Missense | |
| 403 | | 341 | c.1022T>C | p.Leu341Pro | Missense | |
| 404 | | 343 | c.1028C>G | p.Thr343Arg | Missense | |
| 405 | | 343 | c.1028C>A | p.Thr343Lys | Missense | |
| 406 | | 345 | c.1033T>C | p.Tyr345His | Missense | |
| 407 | | 345 | c.1033T>G | p.Tyr345Asp | Missense | |
| 408 | | 345 | c.1034A>G | p.Tyr345Cys | Missense | |
| 409 | | 347 | c.1039C>A | p.Pro347Thr | Missense | |
| 410 | | 347 | c.1039C>T | p.Pro347Ser | Missense | |
| 411 | | 347 | c.1040C>T | p.Pro347Leu | Missense | |
| 412 | | 348 | c.1042C>T | p.Gln348* | Nonsense | |
| 413 | | 348 | c.1043delA | p.Gln348Argfs*47 | Frameshift | |
| 414 | | 348 | c.1046T>C | p.Len349Pro | Missense | |
| 415 | | 354 | c.1061T>G | p.Phe354Cys | Missense | 1.80% |
| 416 | | 355 | e.1063T>C | p.*355Glu | Extending | |
| 417 | | 355 | c.1065A>T | p.*355Cysext*14 | Extending | |

[1]Nucleotide + 1 is the A of the translation initiation codon of the NM_000531.3.
[2]For deletions or insertions, the cDNA nucleotide number is given starting with the A of the translation initiation codon.
[3]%) residual activity in liver or intestine or determined by expression studies; [15N] residual nitrogen incorporation into urea. %) residual activity in liver or intestine or determined by expression studies; [15N] residual nitrogen incorporation into urea.

SEQUENCE LISTING (1334 sequences)

SEQ ID NO: 1 - DNA, 201426 bp, Homo sapiens
gctcttttaaaatagttgctttcttaggaaatgtagttgctttcttaacctcatcaaattcatgaagatttagccgaggcccatggtgagtcttaagctggatatctctcatgttttaaaagatgggtgtttgaaggagcaactcacaagagagaaaaggaaaacgagagacattttatcaattattttttctttaatgattaaaggctatccatttatcccactcacagtctttaagcaattaaatattactgttgttaagcaaggcaggatggtaattgtatattttcatagtatgcctctatcttattttactaatcctttcccctaatgatggacattgtttctaacttccatactacaaataatattcttggaacatgtgcttttatgaatctgtgtgagtatccctgagacatacacccagcagtcaattgctggatcatatgagattctgtacttaatttccccaatgttgttagattgctttccaaaactgctggactagtttatattccctctaacagtatctattgttcactccaagagtattcactccaacatatcaattgtttctgtcatttccatctcctctccaacacttggtattatctagtgttctaatgtttgccattctaatgaataatgtagaatctcactgatgtttaatcttttagtttttctgtggctaatggtgttgaactttccttcatatacctgttagacaattgggctttacctgttcctttatttatttttctattagtgattgcattgttttcctgttgatttgaaagagttttgtttctttttttcccgtgtttgtggggtatattctgtatattaatctcctttcactttagttattgtagatactttctttagtttgttcacattttctaggatatcctttattgaatcacaatctttcatttcgatgaagttaaacccatctaattgtgacactgtgatttgaggatttagcttcatattcaaaatgtctttgtctactcatagactgcaatgacttcccacattttattttattagctttttacctcttatatttaagtctttatctggagtttacttctgaagatgatgtgaagcatgcgtctaaacggaagggaagtagaattatttagaatttaaatataatcaaagcatgtgacttgtaaacacccaaagattttaattgctggaaataatatttccctccctccctccctcctcccccctccccccttcccccctcccttccctccctccctccctgctttccttctctttcttccttcctttttgtcagagaaccaacccagagaatccctccttggttctgatacaaaagaaaagtatttaacatttattgtttgtatttatctactcaggctgccacacaaagaaccatagcaagtggcctgaaacaacagaaatgtatttttccacagttgtgaaggatagaagtctgggattaagatgttagcaggactgattccatctgaggcctgtcttgttggcttgtagatgccgtcttctcctatcttcacatggttgtccctcagtctgtgttgtctgtgtcctaatttcctcttcttacgacaccatcatagtggattatgacttcattgaaccttatcattctttcttttttttttttttttttgagacggagtctcgctctgttgccaggctggagtgcagtggcacgatctcggctcactgcaacctctgactccctggttcaagcgattctcctgcctcagcctccagagtagctgggattacaggcacacaccaccacgcccagctaatttttgtattttcagtagagacggggtttcaccatgttggccaggctggtcttgaactcctgacctcaagtgatatgcctgacttggctaaccttacttttctttaaagacccttctccagcagccacatgctgagatagtgagagttaggacttcaacgtatgaatttggggggcaacaattttagccccaaatagtacctatgctttcacctgtggctatggtggctgaacacatttgtggctaacacaaatttgacagttataattttttatggatcattctacttttgataaatttaggatgattttttaaaaaaatgtaatgttccttcttttaatcactgtagctgtcttgtgtgaactttcaggaaataatcattgtattattgcctctaaaactgaatacttctggaaatctgggatgattgataacagagaaaacaactatattctgagggcattttagttccattctcagactttaatttcaaaatgttataatgtatattagggtgaaaactatgttagttacaaagaggcctcaaaacataatctccaaaatacatagaaatgtatttttcttagttcagattagatttgctccatgtggccattcaggatcacagattccttccatctctgttcccacctccctcagagtgtgatgctctcatcaagtccatgctggtcataggtgtgtcggtattgcagcttgtgagaaggtcaggcacacccagagaagtgcacagaccaggaagtgggatttgtcacttccctcgtgttctactggtgaggatttagtcacttggccacctctagctgcccaggaggctgtgaaatgaagttctctgctgaacagctatgtgttcagctacaatgaaagaaggggaagactgactttggtggacagttaatgtcctccaatacatgatggcagttttagtaactgatagcccctgtctgccagcaaaggcgcagcatgctatagtgtctgtggtgttccttttgcctctaacctcctagcaaccatgccttctctgtttcttcctacctattcccttgatccttgttagctggtgggtctttggggtaaaagagagatcttgagactccatatcctatattttttctagaaactccccacctgctttcaaacacacatatacgcacacagacagacacacacatacaaaatcaagcaaatggtttttacttttttcacttttctcctaagtaccacttgtctctttttttgttgttgacattaccttattttctttttagctcaaagaagtgtaaagcaagagcatctaagcttgagtctaatatcaccacactgctggtttaacacccagctgggactgtgtactactgaagcaattttctgtttcgttcatagtacagaattcatggattgacaggagcaattgccagtggaggaaacaagaacataaacagatgtacaccaagcgcactatggaacacttttaatttcctggagacagtatttcttatggcactggcagcctttcctccctgccttgtcaggatcttattaatgtgctgacagattcctttctctcaatgtacctgctgggtgagagctgctattatatggaacacaggtgtgctggggtttccttgggagattaaaaaagattgtgagtccagaaagttggtaaaagatgtacaaacatttaagctttttcctttctccacctaacacttgtgatgggctctttatcaagcagtgttagtatgtgtctttaacgagaaaaaagaaaaggagacttccccctttgctgttgaaaatatgtgtctatattgcattgttaaatttatgcaggtccccatttctctatatgattgaatttcataatgatgggaaggatggaaagtatccccttctggaggggtcttctcaggacgctgaattgttaatcaagtggattgtttttgcttccatcccatccaaccacacaaaactcagccatggaaagatgatatattaccaaagccctgcattgtcccattctgatgtgttcttttggcatatctgatagttgtacaccctggcaggggagagtagccaacagagagatactcaggcctttgcagtccttcttttaagatttggaattgccacacagcaggtgctcttcagtcatttgaaagagaaaacttaacattttcctacttgcctagtagccacgttatttgtgcttcatttttcctttctatttgccttgagggcaggtgtataggtgagtaactgtaagtagaatgtagttcataagaagtggagaagctgctacttcagggcaataggaatttagcagtggaatttatagacctagaaggacacttcaagaatccagctggttcatcctgtgattgccttgtgggatcatcttgaactgaccatgctactggtcagccagtggctatggcaacagccagggctgcagctgcagagaggagctggcttctttaactggcttcttatacatcatcacaacacctgggctgagcctcaaagcctgggcccaggactgtttttggaactagctgagaaagggaggatgaaattctcaggactaatttcctgcctcctgagggacaggacttggcattcaaggagttatataaaacttttttccctgggtaactccgagttcggaagcagcaattctcatacattgtatcaggagcttgtttaaaacacagattcccagacctcaggaggtttgggttgaatctgcattttaaaaatcttcatatgaaactcttgtagactacgttgaatccctttttttttttttcttttgagatggagtctcgctctgtctcccaggctggagtgcaatggtgcgatctcggctcactcagctcactctcgggttccagcaattctcccaccgcagccccctgagtagctgggattacagacccgtgccaccacgcctggctaattttttgtatttttagtagacacagggtttcaccatgtaccccaggctgatccgcctggccaagtgatccgcccgcctcagcttcccaaagtactggaattacagatgtgagccactgctcccacctgaatcttaatcttaatgtgattcttttgcagactatagactagagtttgacatatgctggtgagagagagagagagagaaagagagagagagagagagagcacaattctgaatataaaagccatggttctaaaggttaacagactgaaattccttgagttatcgtgcccatcaatttacatttgttatatcatagtccctaaagtatttcctaatatttaaaaagaaaaaagaaatatcttttcactgcagcctaacccaatgtgtacttataggtggttatttcacttagatactttcagagaaagagcattcataacttcttttggcagtcaattagggttcttaatgccctcatgttttttccttagatctagactaaatattgatcaaccagaaacttaaacatattttgcgcagaataaagaacaactagtcaagataagtctttttaagttataaaagtttaatttgatcttcttcaggtggaataattcaattttataccctttcatcttggggcctaagtactttaataaagatctatacctttaagccaggggtaagcaaagtaacgctgagggtaccaggaggcatgctgtcgctctgtgtgtaaagactcataaaccttccagagcaattagtggtgttggtaggaacacataaaggccaagaaggggaggttaatccacatccccttcctaataacagcatctactgttttcaagactttactgtaggataggtactttactcgaactatttcctttcatctttggaaagtagtctcatgagtaatactactactcatccctcttacatgtgaggaaacagagacttacatagttatctcactgttccaaggtcaccatcacgtgagtggtgaccccagaccttctgacttgagagccaatatgcttaaccatctactgtcctcctccttctgcccaggtagctccagccaccagcatttcctcgcccttttctccctgctggacatcagggctcttttatgctgccttgactatatgggtcctctcgtaactcccactctccattataaattcctaatttactctctctgcaccaagtctgtatttccctcactctgaatatttaggaacacagttcaaataaactggcatagctatatatgttgccagacaaaccttttacatctgtctgcaaaaatcacattatacctgtttccatgtatcttgtttattcacaaggttggccttacctggatatgtcaggattgggcctctaaaatgtccctgaattatattttctgatttatttgttggttcttttgctcattcattgatccatttacttattcttcagatgggtgttgcaaagtgtctatggagtgcatattgtattctaggtttgaggagtggcttctgaactgaaatatctcacaaataagaaactgaataagcaaacaaatgactacaatgtgcataaatgttatgtcttaagatactaaggaaaccatgagaactcatggtgggagagtcaccttacctgacctgaggcagtcagggaggtttcatagaaggtgacatctgagttgagtttggaaggaagcatagcgatgagccaagtgaaggtgatccaggggaacatcccagatggaagggtcaacctgtgcaaagatgagtcaggcaaagtcacagcactttcacataaatgccaggagcccagctggagcacagagaggggtcaaggcccagaaagaaaagaggttgcagagagacagtggtcttagaacttcttataagacatgacaaggagcttacactttatcctaaagacaatagagagccatggaatgattttgaaactggccaattgtcccatagaactgatgtttatgatttcttttgaataaacatagaaattgaccctcctggttttaaaacttgagacatttacatttgtcttatctgagttcctttctcaggaaaccaaccatcaggcctcccagatagtatcaagggactgtaacttaccagatcaccacatctggacgatgagatgccagaaccacctatcatgactacctaactgactacctgctttctgttgactaactgctcttccttacccctccctaaattctgtattctcatatatgattgcatttctttcctgctataaacccccctaattttagtaggtgtaggagatagacttcagactgatttcccatctctttggcacctgattgaagccttcttccctggaaaaactgattgtctcagtgattggttttctgtgtggcatgcagcagaatctagactgcatccctagtgtttcagtaacagtttttaaaaatagatcttggccaggcatggtggctcacgcctgtaatcccagcactttgggaggctgaggtgggcagatcatgaggtcaggagatcgagaccatcctggctaacatggtgaaaccccgtctctactaaaaatacaaaaaaaaattagccgggcatggtggcaggcacctgtagtcccaactactcgggaggctgaggcaggagaatggtgtgaacccgggaggcgtgagcttgcagtgagccaagatggtgccacggcactccagcctgggtgacagagcaagactacatctcaaaaaaaaaaaaaataaaataaaaataaaaatagatcttatgagacataatggacataagtaaacggtatctaaagtataccatttcataagttttgacttaggtatatacccataaatcatcaccaaaattgagataatgatcattatttctcacccccagattccctcataccatttataattcctccttcctgttttccactgacaatctctgtttcctagccatggacaatcactgatctgctgtctgaaaatatataatttctgcattttctagaattttgaataagtagaattttatagtatgtaattctgatttttttcactcagtataattatttttagatttatctatattgcaggtattaatagtcaatttctttctatttgtcagttttattccattgtatgaatttgcttctcaagatgtatttctccattcatctgttgatgaatggttgaattctatccagccattggctattacaaataaagctacaagtaacatgttcatactttgtatggatacagtctttcatttctcttgtgtagatatctaggagtataatggctgggtagtatgttaaatgtactttaagaaactaataaattgtttcccaaaatgattgtaccatttcacattcccaccagcagtttatgagatttctagttcctccacgtacttacttgtcaatacttggtatattctgcccttctaattttagcattctggtggatttgtagtagtatcgcattgtgattttaactttcatgtccctaattactaatgctgttacattttttaatgcttatttgccagccaaatatatatatatgtatatatatgtgtatatatatacatatatatatacacacacacatacacacacacacacacacacacacacacacacacacacacacaccctgtatatatatatatggtaatgtgtttgttcaaatctttagtcccttcccccattcccagcttttaaattgggatgtttatttacttaatattattcataatagctttgagagatctttatatataagtcatttatgagatatatgtaaaaacatttgttgatgttttctctttggcttcagcttgtcttttcattctcttaaatgtctttgaagagcatctaatgactggtcactcacagaagtacacgtgcccaacacccttgcttcaatctaggaccatcttatgtccttatatcatcttatcatcttacgttttatatccagagctgcccataggatgggctgaagcctcttttctttttttgagatggagtttcactcctgttgcccaggctggagtgcaatggtgcgatcgcggcttaccgcaacctccgcctcctgggttcaagcgattctcctgcctcagcctcctaagtaactgggattacaggcatgcaccaccacatgcagctaattttgtatttccattagagacagggtttctccatgttggtcaggctggtctcgaactcttgacctcaggtgatccgctcgccttggcttcccaaagtgccaggattataagtgtgagccactgcgcccagctagctcttttcaaatgcattgtaggtcaacttctcctttgctcaatctgccttcctcacactctggcttttcacagctcttattccagagggcactccaccataacctcttacatgccaatttctaccttgagtttgtttccaggaaccaagcctaaaaacaggacccatgccttttatttatttatttatttattttttgcttgctttgaattcttactctgtaaatgaattgtgctgtctacacacacaaaaatatacattgaagcatgtctttgtttattcctagttacattttttggaaatgaagtataactcaagaatattcttaacctacattctcatttccttaaataagctattcttaactttctcagaaggacctactgaacaacatgtcactcttttgtcttttcgtgtggcttcagccggagtgctcaccccaccctgcttcttccctgttggcttactgtcacttctctctgccctctgacctcagccatttagatattcagttggaggacttgctctctgttgtcttacatctagctagtacaaatgatagatggaccttgatatacaacagattcaatatgagccacctgaggtttgtggcagctccataatttgtaaaagaagtggcttaggcggctgtcttgtgggttggaacacacagtgggcttgtctaagcctgcatttgcaaaacactttacataaaatagaaaagcatcagttgtacatattaaggaatgaggggtgaggactttggtggaaattacacagatcttcctccaagccatgacttgacattggtattcttccgatgacttgatgtccttatgtttaagattattttaggagttgtttagaacattgtgatgcttttttttttaaagcgaaatctgattcttattttttagaattcttttccccacagtttggcttttctcattcaagtgttcggatagtaaatttacctttgcacatgtttgtgctcccagctgtacatatcaattcgtaaaaagccaaatggagaacagtttagcatcagtgaaatgtcaggaaaatgcccagaaggcaccaacacaatactagagtttcaaattttgagaatggaattaggccacaaaatcagttttcttgcctgtgtcatggaccatggggatgtgtcctagttcttttaaaaaaagggcatctaaacctctctcagtacaacttacaggtctgtgctggggacctgtgagaaacctctggatttgagactaattgaatctgcgttgaaatggccttttcctttctttattaaaaaactgatttgctctaccacctttttctttggcttgcttgcattatccttttttttttaaactgcagaaatcatatattcttcaaggttagaagaaaaaaaaagaagagaaaaaatcagaaccgaatcatactttttgttagatcatgtgtataatattcccttttgtggtggtggaaagaactcacctactctggtttagagggaagaagagtcagttgtcaatgcaaagttctattacaacatctccaaagccatagtttttatttgaaaagcgaggaagtgtgacaacatatgactgggcctgtgattatcattcagacccatacagtgaaaactctgcctgaatttgttcatgaccacatttcttttccaggtttgacagattgtagttttccaactgtctccttattaacatgctgcctgtttcctctatctacttttgctgcacctgctgtgatagtgattgttttgtgtatataggtaccattgccttcagagattaagggcgcacattgtgagcagaaataaaccaatggatttatcagtgactgtacaaattccacctatcttttggacaataactgaaagatctctcttgggaaagtaatgtttttctttgggaattgtgggttaaaaaactatgtttacagctatgcctatctcctcttcctcattccttcattccttctactttttgatttataattgtattccatagccagaaaaatgctaaagaggttaattttttatattataaagtaaaaaaaaaatcctaagtaagtttactgagatttttctagcaaaactagaagtcttagtgggcttcagattcatactcatgaatattcttttaattcttacttttatacaaatcttggaaattagaggtacaatagattattaagaattatgaaaatttattcattggagagcttagcaagaaaattgcttatgttaacatttgaaaaactatttggtctacctgcactgcaaacttatagatgatgggaaagcttatctttaaggcctggatcagtgcaaacagccctgaaaaaggaaatctcgagtttaatttacctttcagaactaaagaatatatattgcagaatttaaagagaaaaggatcttctctcctatctcctaatggatactctttgtacctagggtcagtctgacttggtgggtgcggtatttaactgctgctgaccttgctttgaatttctggctacagagcatttcagaggacagagcaaatcttctgttgggtgtcacataggtagatgcatgctggtgctggttcattcactggcacatcccaggaatgaatattttcttccttgcacattgaccttactctgatagactgacccagaaacagagctggtctagttttatatgtaagtaggaaggaaagttttcttccctggcacatacacctgctagcactctgacacttctaatttggaggtcacaggagcaagtaaataaatactatttaaggagcattaaaagaagaaaatttggtttaaaccaaaaaaatcataaagtggggaggcagagctacaaacaagctgtgggacttcaatcatacttgctttcttccatactattataagaataaaataaaaaaggaaggaagggagaggccgaggcaggcagatcacgaggtcaggagatcgagaccatcctggctaacatggtgaaaccccgtctctactgaaaatacaaaaaattagccgggcgtggtggcggacgcctgtagtcccagctacttgggaggctgaggcaggagaatggcgtgaacccgggaggcggagcttgcagtgagccgagatcctgccactgcactccagcctgggtgacagagcgagactctgtctcaaaaaaaaaaaaaaaaaaggaaggaaggaaagcaggcaggcaggaagaaaggaagaaaggatggaaggaagaaggaaggaaggatgaagaaagaaataaacatatttcactttatacacagccttgcttcagttggagagtgattcaactactctcagctttctctgtaaccactcaggaataccatttagaaaaacgttcttgtagagctagagcctattgctaatagtaatattctggaaaattatggggagatatatatgcttataggcttacctctgacctacaaattgtctctaatagagactgtaattgtgcacaatcccttttttcctcttctgcatagccatgggaagattttctatgtaggcttatgtgaccttcctaggttgtctgaaataatcttgcatctagtacatgaatattacttaataaatccataagtatgtaccaagtgatttggctgcagaatcaaaatttttaaaatgatccatattaactacatctgaatttatccttgagctcctcttctcgttgtaaagtgcattgcacctataaagagaggagtgcagaatacttgtagaagtttgtggggggacagtgaaggacatttattggtctagttaatggtaataggatatatccaaagtggaaataaaagagaggctgtcttaattcaatggtgagccagggctataagtaacaaaaggtggatttcttgggaaatgaatcaattcattttttgtaccatcaaactgggatctaaaatatgaaccccatgatacacatgtacacaatgaaactgttggtctgttattgtaattcttgaaaatctcagtttatagtttttgtgtgtaagataatattatccacagaatcctaggttgggagtctagttctgtttctgcttcagaagactcttgtctcagagaagacccttgaaactctgtggtccctaggatccctcatctgtaagatatagaatgttctaggggcaaagttggaaaatccccttgaggactatgatgttccagactaggacactttataatgcttccaggatgctaatttctggaggcaattagtaggtttgtaaacaaattcttttgaagtgaaggtttgaattgtgtattggcaggaattatttggataattgacttgaatgagtttaattggctataagagtttcatttttgttttgtttcttaggatgatgtaattactgcctgtgttgagttcctgcaggaatgatttaactgttggatattttgaaatgttctggttgtaaaagcatgtatttggtatctgtgtttttttttttttttttttttttttttttttgagacggagtcttgttctgttgccaggctggaatggtgcgatcttggctcactgcaacctccacctcccggttcaagtgattctcctgtctcagcctcccaagtagctgggactacaggcacgtgccaccatgcccagctaattttttgtatttttagtagagatggggtttcactatgttagccaggatggtctctatctcctgacctcgcgatccgcctgccttggactcccaaagtgctgggattagaggcatgagccaccgcacctggacatgtttgtttttttcctggtgttctgagtgtcctgtggcaatgggaagttaccatctcacctccactgttaaggcaccaagtttctacctcttggcccctaagaaatgtgggatcaccttgaacagatctgtcagccctggtgagtttcagatacctgtctcctaagaggaatcttctgctaggttaggggagggggtcctataacagctggaacataggccttcccttcattctgttaacctgaggaatagtcatatcattctgctctctcagttcttgtttcttaacttagcagggaattcagtggagatttaagggtggtagcaataaagcttgtgagagtgcttatgagccactgacagcaaccaacactattgtaagggagttgctagataaccaggaacctggtggctgggcagaagccgacaaagttgactgctatgaatttagattgtggcctaccaatatatgaatagacaagagttagacttcactatccctccagaattctttttctgtgcaataccatgttatcattatataacattcatcatttggaaatctcaaaataagttataagatatagcagcatttgctggctggaaaacctttagacatagttacatagcttaatgacccaaaactttctgctttatgtacatatgaaagtagaggttccaaaatgttaagttaattgctatcgtcctctagcaagtctctacagaagtcagaaataggacagctactgtgaataggtactggataatttttcttttttaagaaatgcaagtaaaagcatttactacgtttactatcactgaagtttgatcatctgcagaaaataacttttaatgtgttctttagaatgaagtatacataggtagtatctgccttctttatttcaccatgaagcctagagggcaactggtagcacagaatttagaagatacttttttttttttgcctatcttgcttttattaattttagaatctgtaagttctttgagaaaggttacatactcaggatatgtagtaagagtgcacaaaaattgaattattaataactaaaatgagaaaagaagtttatattgcaggggttcttaaaacttttttggtgtcttgactgctttggctatctagtgaagcctattaacccctcttggagtactgttttaacaaacaatataaaatacaaaggattcaaagaaaacatatcacattgaaatacagttatacaataacttaaaacattgtgatagagtaatgtgtatgcttcttatttacacattataaacagaatatagcggctgggctaataataataaattcaaagtactgacacatagattttcaagacgtctgcaacaactgcaataataaataaaagtatctataagttctatctgtgataaagtcacaggttctgctaataataccgtgttttggtgcctgcatttatatttgaacagaaaactaaatttcagttatatattagtgaaaataaatgatggaattttgcttttcaattcaagtttatggatcctttgaattttctccctggactcctctctgtgggttcaaagtgaagaagtcttctgttgggttctcagctcatcttttcatcacttgcttctcttagataatgttcaaatactggttacaaataggagaataaatgatgagttcattggacgagaattgaggggagttagcagaagatttctgtaagaacacagtctgggtgtcccaaagcaagttataaagtaatacaatttttcttcgatcccacttaccatcctttctgcatcatcttcctccaagtcaggtgctcagtgtttctgagtgagatgaacaattcaatcagatgtaattgttagtcacaatgttttagtcttcccatggatgtattaagtatatatatttacatatattctacaggaagtggcactatttaatcaaggaaatccaatgccaataatggattttggggatctacccaggatagataggtaaagggatatttttggccgttactgacgcctttcagtcacctaatgattggctatttgtcttgcctatttataagtcagttgtaagtttcattgggcaaacaaaggaagttgttgtttttcagtctgctgttggttttacctttcctggcagtaacgtttccctaggggcaagcaaatactccaagttgaacatctcatttacagcactgtcatttggggtgatagttatttgtagtttgtagaggaattatttcattcatatgagtgaacagatgggttaataaagctgtctgaagttgcaaactggtacacagactatttcagggacatccatcatggtgtcatgttgctgaatgctgaactaccaatagactattagattacaagcaccttgaaaaccagaattaaacctaatctaaacccaagccatagcaacagagtatcgaggtaggctttacttctagtcttcaagaagtgaaggtagcttggcatctgctgctatcatgcaggcattagaacatttaaagaaaacatgtaagctgtgacaatgttaatttcataagaaaaaaatgggtttgtataattttattctgaaatgtgtttcctttattttctaactataaaatggttttgacatcttcaaaaacatcatcgcatagatgcaaacatattttttaaagaactaacactttatagactttaggtgaagggattctgcaaggactgtgacatccaatgggagggtgcttatgtgtggtgtgtatagagacctaataagaactacttcaaagttttacagaacttgtcagaagtcttataactcgtaccaaggggaagataacagcaatcaaagttgtaaataaactagatgttgctggctagcaagatttctctacatagaccctaaacggccctattgtcaagatttgtgtgggagatgcaaaggcaaacacctatcctgtgtgagcactttcagcttcaaatatcatttcaataaatgaatgcaaaaaatagtaaaaaaaatacagcaggatcatggctgggctaggtctaaaataacaaaattatttgttattttaattgtgtgcacaagctgtctcctttttgtagtgagctctgttttgtcttacacttcactgaagtatgcactgcatactgagatttgattgaagccacataagaaggaaagatttggaaggcagtgagggagtctgccatggttgctggttctctatgaggctcaattgttggggtgcacatggcatgcaacactgatgcttgacaatataaggcaatggctttcagctatggctgcacattataataacctagcaagcttctaaaacataccaattaaattagagccttttggggtggggttctgtctttggtatacactaaaaacactccaggtgattctaatatgcagccagggttgaaaatcattggtaaaatggatgcaaatatcagtccataaactcaaatgtgcaagaagcagaacttaattttttattcccagcctcaattttgctactaacttcattcttttttatggtttacttaaccctgtagttcagagttcttatgcagcgcaaaattttggggagcagaggaacctcttatttgtaggtcatctgtccactaaagttaccattggatgtcccatcaccccatcaacatgacacttttggtccagtggtgcggcatgcttcgagaactggcatctttctgtgatgtgcctccactcaagaactaggtctgagcctaagggatgccacaaaactcagtagtcacacaagtcatattttaatgtataattactgatgtctaaattaatgcaaaaaatccacaatgaacaaaatatcggaagtttaaataaaaacagtgtcagtacccactctgtccccagcttttcttcttgtggtaggaaatactgcctctctagcaatgtgcagactgcagttttttcctgcttgttcattccagttgaggaaaatgtcatttaatcccggaaaaatatttttccttttgtgtttctgtcttgcatatttaatctactctggagaatattcttttgtacacctgtttccaaattaggtgtaaagttttggaaaagagtatatgaagaaaagtactcagtaggcaacttgcaatgtttgctttgccatttctctcttatttgtcaccgagcatagaattcactacctgcttgaggtatatgtgactgtgtatgtgtgtgtgggtgagtgtgtgtgtgtgcatgaagggatagagtgccataagggtctccttacctccctcttttctttttttcctccctctctcactccctccttccttaccttcctcccctctttccctccctgtgttcttccttccttgctgcaaaataaaggcaaattggtaggcaacttaagatattttttattatttatcaaatattcagatactatttttgccaacatgccctgtagtccatacagggaatttcttggacttgcacctcaccaaaaacttccacctagcaggggcactagaagcttctgtggcatctgtccctgggttctgtgatttgcacaagagaatgctcaacttttccactccacattttactatgtaaggaatgaaaccaaaactgtgtatgtctctctgtctccagagcctttggtggaaacaagtccttctgcctttgttctcctatctctcagatggtggttgataacccccatcttgttatcagcatttcctgcctctattccttgggtgtctttgaataaataatttccttttcttctagacacaaataagagctaacataggaattaacttaagcaaattgagtcttcttgaggagctcctgtgcaaagatgtctggatgtcagcagatcatgtttcttggcaagagagaaggacaatgaattcatggaggctagatcatctagggccctatttgcaaggaatttggctgtttctcagcatgagatgagaaggcatcagaggatactgaatagagaagtgacataacctacatagaacttaaccttagttgcactactctcttgctagcttcctgctcttcctccaacatgcaggcacacttcctcctcagggctttggtacttgctcttctatttgcttgagacgtttgtcccacagatagctgcacggctcagtgcctcaccttctcagcaacatccttcctggtcaccctatttaatacttaaacttcttatactttttcttcgctactttattttccttcattgcatttatctaatactatgtgttaactgtctatgtcatttattttctgtcaaagaaaaataattatattctggacagctggtctgttttttatcaaatagggaatggaaatcttttaactgattatatctttccttcttttatttttggaattagctctaataagctcagcaaactttgtgtaagatctaattaaggggtatcttcttgtatgctaactcttccagatttcatcttactatttggtcatcattacatttgacccagatttaaatttttaaaaaatgtattactgttttatatctacttttgtttcaaataatctttaagcaaggcatgtcataaagaagaatttatccttatatctcctatacccagtgaagtttgtgcatatagaacatgttaataagctgaatatgatatgtaaaatgtaataaaatgttaaaaatattcatatcctatttacctcgggaggtttatactttatttttatttaatttttttataatttcaaattttatgttagatttgggggtaatgagcaggtttgttacataggtatattgtgtgatgccgaggtttgggatacaaatgatcccatctcccagatactaagcatagtacccaacagtttttcaacccttgtccccatacctctctccccactccaacagtcttcagtttctattgttgccatttttgtgtccatgagtactcagtgtttaggtcccacttataggcaagaacatgcagtatttggtgttttgttcctgcattaattcgcttaggataatagccccagctgcatccacgttgctggaaagaacataatttcattcttttttgtggctgtttagtatcccatggtgtatatgtagcacattttctgtatccaatctaccattaaaggcacctaggttgattccacgtctttgctattctgaagagtgctgcaataaatatgtgcatgcatgtgtctttttggtagaacaatatatacatacatatatatatatatatatatatatatctccagtaatgcagtcatggggttgctgggctgaatggtagttctgctttgagttctttgagaaatctctaaactgctttccacagtggctgagctaattaacattcccatcaacagtgtataagcattcccttttcttcacagcctcgccagcatcggttgttttttgactttttaataacggccattcttactggtatgagattgtatcttattttggttttgacttgtgtttctctgatgattagttatgtggagcattttttcatgtttgctgacgtatgaagatgacatatgttgtatgtcttcttgttagaagtgtctgtccatgtcttttgcccattttttaatggggtttgagcatagaatatttttccactggtttgtgtcatctattatttctttgagcagtgttttgtagtagttctccttgtagaaatctttcacctccttggttaaatatatttctaggtattttattttatttttttctgtggctattgtaaatgggattgcattcttgatttggttctcagcttgagtgttattggtgtatggaaatgctagtgagttttgacactgattttgtattgtgaatctttacaaagttatttatcagttccaggagccttttggtgggtctttagggttttctaggcgtagaatcatatcagtgaagagagacagtttgacatcttctttacttatttggatgccttttatttccctctcttgccttcaaaccagagatctatctaggcatggagctgggaaacctttctggccccaagttctctgcatggggatggaaggcagcctaaattcttattccagtagagtgggtgctctagatgcttggagatctgcctgggtgtggagtgtagagggccttgctggaccacaatctctgcacagatagggcgggagagctcaggctggcaagccaggataacaggtactcttactgcttggagatatgcctgtgcatggagtaaagagggctgtgcttcaccatggtgtctgaacaggatgggtgggctggctcaggctgttgattcaggtgagtggatgctccaaatgcctggatatctgccagagggtggagcagagagggcctgggcttcaccacagtctccacacaggaatggttgggtggcttggtatgctgatctgggtgaatggtagctgcaactgctaggagatctgcctgggcatgaagcagagagggccctgctgtaccatgatctctgcacaggcagggtggggtatcttaggttgctagtcaatgtcaccaggtgtttcaaatacctggatttctgcctgggagtggagtggagagggacccactgcaccgtgatcccagagaaggaggttgggccacccagaaatgatacacataaacctgttctatgtctccaagctggtcctggctgcaagtctcctcatccaggagaaactggatgagcagctttcctccagctccaggcctgtgacaggggagagcacaattccagtgcctactgatgaggcactttctgtaattctggctgtagagacctctacaccactccagagcaagcgctccaatctctggcccaagacaaaaatgcctgtgcagccacggtgccagattgccaaagaatggctgactttgtatgcactcgggttaaaaacggcatcctgctttcagtcctgggtctgagaaaatgcctgcagcttttccctgtgtcttttcctctcagcacttccaagcctctctccaagttagctccaggacttgggagaaaaaagtgctctccctcagcctaggttgctgggatccccagtggaaaggtgagtagtagagggaggctctcctcccctctcacgtactggggcttcacacattgtcagccagatgccatcatgagggctgtttgcccacgttcttctccttgggagctggagtatctttcacaatatcaggggattcgtgttgtattagtttgttctcacactgtatgaagaaattcccaagactggataatttataaggaaaaaaggtttaattgactcacagttatccacggtttttaggggaggcctcaggaagcttacaattatggtggaaggcacatcttcacagggtggcaggagagagaatgagtgccaagcaaagggggaagccccttataaaaccatcagatctcatgagaactcatccactatcatgaaaacagcatgggggaaccgcccccatgattcaattatctccacctgatcccgcccttgacacctggggattatcatttcaagattacaattcaagatgagatttgggtggggacacagccatgtgatatcatcccaccactggctcctcccaaatctcatgtcctcaaatttcaaaacacaatcatgccctcccaacagtcccccaaagtcttaattcattccagcattaacccaaaagtcaaagtccaaagtttcatctgagataaggcaagtctcttctgcctatagggctataaaatccaaagcaagttagttccttcctagatacagtggaggtacaggccttgggtaaatacacctattccaaatgggagaaattggccaaaacaaagggtctacagtccccatgcaagtccgacattcaatagggcagtcattaaaacttaaagctccaaaatgatctcctttgactcttatgtctcatatccaggtcacactgatgcaagaggaaggctcccacatccttggcagctctgcccctgtggctttgcagggtgcaggctcctcccagctgttttcacgactggcactgagtgtttgcagttttccaggcgtactgtgaaagctggtgatggatctaccattctggggtctggaggatggtggccctcttctcacagctccactaggcagtgccccagtggggactttgtgtgggggctccaaccccatctttcccttccacactgccctagcagagggttctccatgagggctctaaccctacagcaaatttctgcttggacatctaggtgtttccatatatcctctgaaatctaggtggaggtccccaaacttcaattcttgacttctctgcacccacaggctcaacaccatgtggaaactgccaggcttggggcttgtgccctctgaagccatggccagagctgtaccttgggcatttttagccatggctagagtggctgggaaacagagcaccaagtctctaggctgcacacatcggggggccctggacctggtcccaggaaaccatattttcctcccaggcctctgggcctataatgggaggggctgccatgaaggtcactgacataccctggggacattttcccattgtcttggtgattaacattctgctccttgttacttagcaaattgctgtgataggcttgaatttctcctcaggaaatgggtttttcttttctattgcatcatcaggctgcaaattttccaaacttttatgctctgcttcccttttaaacataagttgcaatcccaaaccatatctttgtgaatacgtaaaactgaatgcttttaacagcacccaagtcacttcttgaatgctttgctgcttagaaatttcttccaccagataccctaaatcatctctctcaagttcaaagttctacagatctctagggcaggggcaaaataccaccagtccctttgctaaagcatagcaatactcacctttattctaattcccaacaagttcctcatctctatctgagaccatctcagcctggacttcattgtccatatctctgtcagcattttagtcaaaaccattagacaagtctctaggaagttccaaactttctcacatcttcctgtcttcttctgagccctccaaactgttccaacctctgcctgttacccacttctaaagtcatctccacattttcagctatctttacagcagcctcccattacccagtaccaagttactgtattagtctgttttcaggctgtgatgaaaaaattcctgaaactgtgtaatttataagggaaaaaggtttaattgactcacagttccacatggctggagagccctcaagaaacttgcaattatggcaggaggcacctcctcacagggtggcaggagagaaaatgagtgccgagaagtggggaaagccctttatatagccatcagatcttgtgagaacccactcaccatcatgagaacagcatgggggaaactgcccccatgattcaattatttccacctggtcccacccttgacacgtggagattatcacaactcaaggtgagatttgagtggggacacaaagccaaaccatattaccaattttccttctcgaattaatgctcacagagttgatctttgtgcaatatcttgctatttccaagtggtcgaggcacactgaaagcttctaatccaccatcttgggaaaaaataatctctctctctctatatatatatatttttttatatatatgtatattttatatatatataatatatatataaaagagagatatagagatatctatgagatacatatagatatatatatttatatataaaagagatataaatatagagatatattttttatatatatatacacacatatatacatataatgttaaaaagcatcttttcaaataaatgctgcttgcatatgttaatttagtttgaacaattttggagtggatttcaggacaggagagagaaaaaagcaaagagcaaaacaactccactctaaagggaagtcatagttcctgggtctgagtggtgcttcttgcctccatcctgccctgacccttcatagtctcgtgactttcacattgctctaataagatatcaaaatttgagtgaggggttcagttcctatctctgttctcccagtaatgcaacaaaaagggtaacttgtccctcctctttacattttaaaataaggaagggttgaattagctcagtgtttctcaaggcttgattcaccttaattgactgaagagctttttaaaaatcccaatttctttggcccttgtcatagacattctgattccttttatttggcagaagacccaggcactgacctaatttttaaaagttctgtatatggttctcttgtgcaggcagaattgagatcattggctttgctaaggtatctccagcactgacatcctgtgactaggtggataatttaactcttcctaactctacagaaaaagtgagaagctctagagattccactggtaacctcttcaaggttatgtcacatgctgccactagatggcgcaggcaattcttgggacggaggagattctggttatttgggattttcattttccctgtgcaatatacttgagacactcagcttaagaagcttcgtgggggaatgacattttagctcctttcccaaagctcgaggcccagaaggtagagctgttttgcttgacaagttgatagagagagactcattaaataaacgttctatcgtctgaagggagaaagtaaaacccccggcataaatattagttcacatttttcttattatttccagcaggtgtgtgttctccccttctctgtgtctttctctctcttactctttgttggtggcctctttttacctttatcttttcccttttcttggtttctgtctgtaaccactgtttgtaaactggttatgatgaatttacaggtggattaaatcttagtttgccacctttgtcgtagataaaaattttaggaatccaaaaacgatacctacacaatattcttagaagggtgaacacattcaggttacaatggaaaaattcttattcaggagacttcctctgcaatgttgtttgttcatagcagctgtggtagcacccgccaaatccaggaagaaagaattttatgccgtatcagggaaaaacagtcaaaatcctttcctctttacagcacaattcgggtgacggccaaagctcttagtgtacatacaagtaggggtttttgcacaataatagggtgtgcttctctgatgcttttcactggaagaccacatagcacattgctgctttattccataaagctgcctctttcccctgggctgtcagaataggaagatgtgttgtgattttttttttcaaagagattgcattccttccctggctttgtcccagcccagctgcttgttgttcagggagatgctgcgcttttggtgccaggatataccactgtgctttctttttccctgagtgacatatactgatgggtcactgcctgaaacagtggaacaaggcatggtgtgtgtccacccgtgaagatccattgtttattcttccctagtttccatctagcagcatcaggttcccatcttcattaagaaacaaaacaaccgaccaaacaaataaaaccccacaaacaatgcaaaataaaccaccacaaatgcaagaaaaaagtcttttttaaattttacattaatagctaacgttgagtgcaaactatattctggatattgttttaatcacttgtcatatgttgtgtcattaatcctcacatcagtgtcatgagctaggtcctattattatccccattttacagatgaagaaattgagtaaaagtagggttaagtaagttgctcaatgtcatgcagctgataagttgctgagccaagctctgattccaggcaatctgacacagtacaccttaactctgtatctagattccaaagggttgtgtattggagtaacaagcaagtaaaggatagattctccaattggatagttgttagaaaagggtgtatttcctgttaatgtagctatatttcttttggtataagattcaacagatgctccaaacccagttctaccccatgctggaggacctaagtacattgtggcatacccacttcttactggcagaaaaattaaaaggcgggaaacttccttctcagttgtgactgggatcatttagtgtgtctgcacaatcctaaataaatttggaaagtgaacaattgggaggacgacctactttttttttctgactcacttctacactacttaaaagtaaataggaataggggctgatatataaggcatttgggagctttttctcgttggtcatacattaacctctttaggtcaacagaagtctggaagaaggaggccaccacacactctgcctaagagtgtgtttttagtgtaattcatgctgtattgggcatgaagaaagcagacagctttctgaaatgagctatttccaagggagtacaatcatattgcaaagaaagcacctagaaggaagaaattcatcctataattagggctctgaaatattttcaatcaacatataggttggtgcaaaagtaattgcagtttttgccattgaaagtagtggccaaaactgcaattactttagcaccaacctaatatcatgaagaaagaaaagaagcacagtccttgctagaaaacagtgataatctcaatagaagaatctaagagctagaagactcagttggaaacagcagaatcgggccaaataggaacagctccagtctactgctcccggcgtgagcgacacagaagacgaatgatttctgcatttccaactgaggtactgggttcatctcactggggagtatcagacagtgggtgcaggacagtgggtgcagtgcactgagcatgagccgaagcagggcgagcatcgcctcacccgggaagcacaaggggtcagggaattccctttcttagccagggaaaggggtgacagagggcacctggaaaattgggtcactcccaccctaacactttgcttttccaaccgtcttagcaaacggcacaccaggagattgtatcccacacctggcacgaagggtcctatgcccacggagacttgctcattgctaatacagcagtctgagatcaaactgcaaggtggcagcgaggctgggggaggggcacctgccattgctgaggcttgagtatgtaaaaaaagcacagggaagctcgaactgggtggagcccaccgcagctcaaggaggcatggctgcctctgtagactccacctctgggggcaggcatagccaaacaaaaggcagcagaaacctctgcagacttaaatgtccctgtctgacagttttgaagagagtagtggttctcccagcatgcagctggagatctggaatggacagactgcctcctcaagtgggtgctgacccccgaatagcctaactgggaggcactccacagtaggggcagactgacacctcacatggccgggtactcctctgagacaaaacttccagaggaacgatcgggcagcaacatttgctgttcgccaatatccgctgttctgcagcctccgcttctgatacccaggcaaacagggtcaggagtggacctccagcaaactccaacagacctgcagctgagggtcctgactgttagaaggaaaactaacaagcagaaaagacatccacaccaaaaccccatctgtatgtcaccatcatcaaagaccaaaggtagataaaaccacaaagatggggaaaaaacagagcagaaaaactgaaaattctaaaatcagagcgcctcttctactctactccaaaggaacgcagctcctcaccagcaatgaaacatggagaatgactctgacgagctgagagaaggcttcagacaatcaaactactccaagctaaaggaggaagttcgaacccatggcaaagaagttaaaaaccttgaaaaaagattagacaaatggctaactagaataaccaatgcaaagaagtccttaaaggacctgatggagctgaaaaccaaggcacgagaactacgtgacgaatgcacaagcctcagtagccaattcgatcaactggaagaaagggtatcagtgatggaagatcaaacgaatgaaatgaagtgagaagagaagtttagagaaaaaagaataaaaagaaatgaacaaagcctccaagaaatatgggactttgtgaaaagaccaaatctatgtctgattggtgtacctgaaagtgacagggagaatgggaccaagttggaaaacactctgcaggatattatccaggagaacttccctaatctagcaaggcaggccaacattcagattcaggaaatacagagaacgccacaaagatactcctcaagaagagcaactccaagacacagaattgtcagattcaccaaagttgaaatgcaggaaaaaatgttaagggcagccagagagaaaggtcgggttacccataaagggaagcctatcagactaacaatggatctctcggcagaaactctagaaggcagaagagagtgggggccaatattcaacattcttaaagaaaagaattttcaacccagaatttcttatccagtgaaactaagcttcataagtgaaggagaaataaaatactttatagataagcaaatgctgagagattttctcaccaccaggcctgccctaaaagagctcctgaaggaagcactaaacatggaaaggaacaactggtaccacccactgcaaaaacatgccaaattgtaaagaccagcgaggctaggaagaaagtgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctctgataaaacagactttaaaccaacaaagatcaaaagtgacaaagaaggccattacatgatggtaaagggatcaatgcaacaagaagagctaactatcctaaatatatatgcacccaatacaggagcacccagattcataaagcaagtccttagagacctacaaagagacttagactcccacacaataataatgggagactttaacaccccactgtcaacattagacagatcaacgagacagaaagttaacaaggatatccagaaattgaattcagttctgcaccaagcagacctaatagacatctacagaactctccaccccaaatcaacagaatagacattcttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacacggaaactgaacaacctgctcctgagtgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacatttaaaagctagcagaaggcaagaaataactaagatcagagcagaactgaaggaaatagagacacaaaaaacccttcaaaaaatcaatgaatccaggagctggttttgtgaaaagatcaacaaaattgatagaccactagcaagactaataaagaagaaaacagagaagaatcaaatagatgcaattaaaaaatgataaaggggatatcaccactgatcctacagaaatacaaactaccatcagagaatagtataaacacctctacgcaaataaactagaaaatctagaagaaatggataaattccttgacacatacaccctcccaagactaaaccaggaagaagttgaatctctgaatagaccgataacaggctctgaaattgaggcaataattaatagcttaccaaccaaaaaaagtccgggaccagacagattcacagctgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaagatccctgatgaacatcaatgcaaaaatcctcaatataatactggcaaaccgaatccagcagcacatcaaaaagcttatccaccatgatcaagtgggcttcatccctgggatgcaaggctggttcaacatatgcaaatcattaaacataatccagtatataaacagaaccaatgacaaaaaccacatgattatctcaatagatgcagaaaaggcctttgacaaaattcaacagcacttcatgctaaaaactctcaataaattaggtattgatgggacatatctcaaaataataagagctatctatgacaaacccacagccaatatcatactgaatgggcaaaaactggaagcattccctttgaaaactggcacatgatagggatgccctctctcaccactcctattcaacatagtgttggaagttctggccagggcaatcaggcaggagaaggaaataaagggtattcagttaggaaaagaggaaatcaaattgttcctgtttgcagatgatgtgatagtatatctagaaaacccatcgtctcagcccaaaatctccttaagctgataggcaacttcagcaaagtctcaggatacaaaatcaatgtgcaaaaatcacaagcattcttataccattagcagacaaacagagagccaaatcatgagtgaactcccattcacaattgcttcagagaataaaatacctaggatccaacttacaagggatgtgaaggacctctttaaggagaactacaaaccactgctcaatgaaaataaaagaggatacaaacaaatggaagaacattccatgctcatgggtaggaacaatcaatatcgtgaaaatggccatactgcccaaggtaatttatagattcaatgccatccccatcaagctaccaatgactttcttcacagaattggagaaaactactttaaagttcatatggaaccaaaaaagagcccgcatcgccaagtcaatcctaagccaaaagaacaaagctggaggcatcacactacctgacttcaaactatactacaaggcaacagtaacccaaacagcatggtactggtaccaaaacagagatctagaccaatggaacagaacagagccctcagaaataatgccacgttatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagatttaaatgttagacctaaaaccataaaaaccctagaagaaaacctaggcaataccattcaggacataggcatgggcaagggcaaggacttcatgtctaaaacacccaaagcaatggcaacaaaagccaaaactgacaaatgggaactaattaaactaaagagcttctgcacagcaaaagaaactatcatcagagtgaataggcaacctacagaatgggacaaaatttttgcaatctgctcatctgacaaagggctaatatccagaatctacaaagaactcaaacaaatttacaagaaaaaaacaaccccatcaacaagtgggcgaaggatatgaacagacgcttctcaaaagaagacatttatgcagccaaaagacacatgaaaaaatgctcatcatcactggccatcagagaaatgcaaatcaaaaccacaatgagataccatctcacaccagttagaatggcgatcattaagaagtcaggaaacaacaggtgctgaagaggatgtggagaaataggaacaattttacactgttggtgggactgtaaactagttcaacaattgtggaagtcagtgtggcgattcctcagggatctagaactagaaatatcgtttgacccagccatcccattactggatgtatatccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccttaaaaaatgatgagttcatgtcctttgtagggacatggatgaagctggaaaccatcattctcagcaaaccatcgcaaggagaaaaaaccaaacaccgcatgttcttactcataggtgggaaatgaacaatgagaacacatggacacaggaaggggaacatcacacacttggggcctgttgtggggtgggggtagcgggtagggagagcattaggagatatacctaatgctaaatgacgagttaatgggtgcagcacaccaacatggcacatgtatacatatgtaacaaacctgcacattgtgcacatgtaccctcaaacttaaattataataataaacaaaaagaaaacagcagaatcacagggcaaatgtccatgggagctgatgaagagagactcagtattcaaagacttttacaacttcataagcaaagcttaagactcagtgataggctcacgtgatactcccggtcaaacctaatgagacaaggacggtaatggggtttgcctagaacaacatagaaaggagctattaccagatccacctggttgagggtaaatacaattcctgaatgagggaggactatagactaaactcaaaactgactgaaatattttacaattgcaggcatatataccttgtgtatttttcttatttacacattgtggtttcaataatcttcaataaatttattcacatcaacatcattctctagttaaagaatttctcttaagtcttattctacatgagtcattgaaccccaaattgagccaaatttcagattcaccaattaattgcctcctgatatttccttaccacccacaggcagctcaagttggacatcattaaaagtgaacttaccatttttccctagccctcttcattttcctagagaccacatttcagagaatgacaaaaccagctgcattgtttctaaagcccgaaacatggatggtgacttttatgtgtgcaaatatttacttatgtttttcttttattattattttttcaacttttattttggattcagacgttacatgtgcaggtttgttacatgggtatattgtgtgatgccaaggtttgggatacaaatgataccatcacccagatagtgggcatagtacccaacaattttccaatccttgtccccatgcctccttccccactccagtattccccagtttctcttgttgccatctttatgttcatgagtacccaatgtttagctcccacttaaaagtaagaacatgcagtatttggttttttgttcctgcattaattcatttaggataatggcctccagctacatccacattgcagcaaaggacatgattttattctttttttatggctgtgtaatattctatggtatatatgcagcatgttttctttgttcaatctaccattaatgggcacctaggttgattccatatctttgctattctgaagagtgctgcaatgaacatgtgtatgcatgtgtctttttggtagaacaatttattttcttttggatacatacatatcctccagtagttttatatatatatatatatatatatatatatatatatatatatatatatatggagagagagatatatatatatggagagagagagatatatatatggagatatacatatatggagatatatatatatagatatatatatatagagatatatatatggagatatatatatatggagatatatatatggagatatatatatatggagagatatatatatggagatatatatatggagatatatatatatggagagatatatatatggagatatatatatatctatatatctatatatttatatatatatggagatatatatatatggagatatatatgtggagatatatatatggagatacatatatatggggatatatatatggagatatatatatatggagatatatatatggggagatatatatatatgtatggatatatatatatatctctctctctccataatgggattgctgggtcaaatggtagttctgctttgagttctttgagaaatctctaaactgctttctacagtagctgagctaatttacattcccttcaacagtgtataagcattcccttttctccacagcctcaccagcatctgtgttttttgactttttaataacagccattcctactggtgtgagatggaatctcactgtggttttgacttgcatttctctgacagttatgtggagcattatttcatatgtttgctgacatatgagaagacatacgttgtatgtcttcttgtgagaaatgtctgtccatgtctgttgcctgttttttaatggggttaagttggtttttgcctgttgaattgttgaagttgcttatagattccagatagtagacctttgttggatgcatagtttgcaaatattttctcccattctgtaggttgtctgtgtactctgttgatagtttcttctgctgtgcagctctttagtttaattaggtcccacttgtgaatttttgtttctgttgcaagtgcttttgaggacttagtcataaattctttcccaaggccaatgtccagaatggtgtttcttaggctttcttctaggattcttatagtttgaggtcttacattaaatctttaatccatcttcagtggctttttgtgtatggtgaaaggtaggagtccagtgtcatttttctgcatatggctagtcagatatcccaggacaatttattgaataggaagttctttccccattgcttgtttttgttgagtttgtcaaagatcagatggctgtacgtggcactgtttctgggctctctattctgtttcattggtctatatgcctgtttttgtagcagtagcatgctgtttttgttactgtagctttatagtatagttttaagttgggtgatgttatgtttccagctttgttctttttgcttagtattcctttggcttctcaagctcttttttggttccatatgaattgtagaatagtttcttctagttctgtaaaaaatgacattggttgtttgataggaatagtgttgaatctgtagcttgctttgggaagtgtggccattttaataatattgattcttcctatccatgaacataaaatgtttttccatttgtttgtgtcatctatgattcctttgaggagtgttttgtatttctccttgtagagatctctcacctccttaggtagatgtattcctaggtatttttttttgtagctattgtaaatgagactgcattcttgattaggctctcagcttgaacattattggtatatggaaatgctctggatttttgtacattgattttatattgtgaaactttactgaaagtgtttatctgttccagaagctttggcagggtctttagggttttctaggcatagaatcatataatcagtgaagagagatagttagacttcttctttacctatttggatgccttttatttccttatcttgcttgattggtctgcttggtacttctagtactatgttgaattggttgaattggagtggtaagaataggcatccttgtcttgttccagttctcaatgggaatgcttctttttttttttttggtctgtttagtgtgatgctggttgtgcatttgtcatagatgactcttcttattttcaggtacattgcttcagtgcctagtttgttgagtttttttttttaatcattaagcgatgttggattttatctaaagctttttctacctcttttacaatgatcatatgttttgttgttaattctctttatgtggtaaatcgaatttattgatatgtgtatgttgcatgaactttacaccctaggaatgaaggctacatcatcatggtgaattaacttttcaatatgctgttgaatttgatttgctagtatcttgttgaagatttttgtgtctatgttgatcaggaatattggcctgcattttgtttttttttctttgtgtcttttccaggttttggtatcaggtgaatgctggcttcatagaatgagttaggaaggagtccttcctctttctgtttttggagtaatttctgtagaattgaaacaagctcttctttgtatgtctggtagaattttgctgtgaatctatttgctgtagagctttttttggttggtaggtttttttttattactgattcaattttggaacttgatattggtctgttaaaggtttcaatatttctttctgattaaatgttagtagattgtgtgtttctaggaatttatgtgtttcctctagattttgtattttgtgtgtgtagatgtgttcatagtcgtctctgagaatcttttgtatttctgtgggattggtgctaatgtcacttttgttgtttctgattgtgcttattttgatctctctctttttgttgttaatctaggtagtggtctcttgatcttgtttattctttcaaagaacccacttttagttttgttgatgttttttgtatagatttttgtgtctcatttcattcagttccactctgttagttatttctttccttttgctagctgcggggttagtttatttacctttttctagttcctgtaggtgtgatgttagatcgttaatttgagatctttctagctttttgaggtgggtatttagtgctataatcttttgtcataacattgcttttgctgcatcacagagattttgctatgttgtatctctgttttcatttatttcaaggaaattaaaaaattttcttccttaatttcattgtttacccaaaagtcatttaggaggagcagggtgttattaatttcatgtaattctgtggttttgagagatcttcttgatattgctttctgtttcattccactgcggtgtgagagtatttctatgtttttgaatttattgaaattcaataaatttgaatggctgagcatgtggttgacctttgagtatgttctgtgtgtagatgtgaaagatgtacattctatggttgctgggtggagtatttttaggtgtctattaggtaccatttgtcaagtgtcatatttaagtccagaattttttgttagttttctgcctcaatgatctgtctaatgctgtcagtggggtttaagttcggttgatgacttcttatacttctctctttcttattctttctctctcaccacctcatccaattgattcacaatgcctacaccttctattttctaacaaactcttgaatttaattgcgccttttcctctttcccagtgtctttaagttcacaatcctttcacttctaacctatgttattgtctttctgtctcctctgaccacattcctatgtgctcttctctttgctttggtgatttttctaacacgcatatctgatcatattacttctctgtttaaactccttcagtagttctgtagagcctttaggacgaaactaaactctgccttactgaattaagcacatgatgatttgaactctggttatctctacctcatacccccacctcatcttttgcatgcagtgctccacatgggctactggatcaggtcttgctatctttatatatgctgttctctctatcatcccttacttgtccttcacaactcagctcatgctatcttctgcagaaagcttttaaatgatagaccccagctatatagttaagacttcactttttctttgattcttcaatatttttccaattcatctctttaccacatctatgatatcaggcttttcttattccatatcagttatttattaaaatattagcttgctttttctaatgtccttttcctgtctctattctttgtctttatgcatatattaatatatgtctattggtgctgagttttggcttagtcttttctatatccctattttatttctctacatattttccatatgatgttttataaacgaggaaatatttcataaaggaccttataattccactttattaataacactaacctaaggaaagtccaagacaaacacattgaactttttcactaaattcttttaagttagtcttgctgtaatcatactgttctcagcagttaaacgtttagttgtatcaaagactaatatactttattggtgcataatcttcaaagagtcttaaggtctccaaaccagagagctagcacaggcataggtcagaagtccacggcgtgctcatgacttattgtaaagtaaaggtttctatttgtcgatgataagacaagtagactaagatcagcccaattcataaatttggtctgggtcagatgcaattcacagatatcaaccaatagatgtgtgaattgcaattgttagtggccttgaactgccccaccttgaatcgagggaaatcaatgtggctttgttcagcagtgactgcctgaaaggaccataaatcaggagcctccacagaacccttttattgtcaaggtaatggcaaagaaaaatgatagcagttattccatttacagagtttagccttttttcttcttcctgattgttgtttcttccagttttctttttgtatctgaataatcacagcatgtagcttttgaatttttttcctagaggaatgtgtgatataaaacaccataaagttcgcagttagaaggatgtcttaaataattttgtcaaaactcttatggctatgctgtagtttgaactggccaaccaaacggtcatccaaaattagagttttatacctttggtaactgttagccaccgtttctaatttcatatcgtaattatatgtcagacccaggccattatacatgctatctatgtgactgaaatttgttcattttcccctataaaaactgattagtagcagtagattgctgttggtaatgctatgatagtttaagtgccatatagtttaagaaccatatatggttctctatagtcatgatgccctgacatttttgtatgttgtggtctgttgtgtctttccagagatttgtcactaatatttctcaaggtaccaactattgtgagtttctaattttataaattagactagatttgcagtgatctctatgatgatgctgttactgccacttaatttctttagtgggagagatagtattgctggggccatttgtcccaggtatattagccaaatgctaattattgctcaatatctgttctcttccttttccttagtaaaagaagaccagatttttcaagtaggtagatgcgtggttagaataaagactatatttcccaaccattcttgtagatagatgtggccatttactgtgttctggccaatggaatgaaggtggaagtaatgtccagcttactgaaagtgtctccaaagggaatggcttgctactttttcttctttcttttttctatatgactggaatacagatatgatggctgaggcaccagcagccatgttggaccttgggaaaggaagtcacgtaagaaaaggaacagggtctcattctgtgtagcctcatagctgcccaactgctgtatttaacagatgtgggagagaactaagtttctaacttattaagcttcggctatttttttttctgaactaaattctctttattacaaaatacaaacaaaataaagattgagaactgacactgacaattacgtgtttcctaaattcccgaccaacatttctgaatgctgaacctttccaggtgggtgacctgcaggccctttaaatctaaatttaccaaattcagctcattatcttaacctcaaaattttctcctcttgtgttttttaaggtttttattaattccaaatgaaagccttaaaaacatctttagttcctacccttctctcaccaattatgtgagtgaaaccagcagagttaagattttcttctgaaatggtcttacaaaatcagaatacaatcttaagtttcttgatgagtttctgtagaaaattagatgtgtttattaacttgtgccaagttgttccttgctctttgtataactgtcccatctttacacattaattattaattttgccttatcagagttgctatttaatactttaattcaacttctggagaactgattgcattttgcccaaggtgtaatcccactttctgaaactacagataagttatatgaaaattctttaaaaatgaatagactatgtgcatctaaagtattcctaatatatttcatattcttttgatgccattctgaaagtgaaactataattcatcactttagtatcagtaataaacattaaaaaggtgttgcatctgaagtttgaaatactgtagtgtacaaaattttctttcctagaaagtgatgcttaaagaaatgttagtagtttggcataggtctaattctgaataattattgtcattgacaactatcattatttgcagctacccattatcttctaaatggccttcagaaatgatggagaaactgacacgttatgagtatttcctgccctacatggattttgaacttgaattcccagcctcgcttgcatctagacacaggcacgtgacccaagccccaccagtcagacaaacccaattgaaactttagttcaaaagcatccagtatgagggagcagtgaagtttgcattttcctgatgaaaatgttggaagaggtatttggctttgttggcggggagggcaatgatttatgcaaaagttcctaatgaaaaaatggctttgttctgggttgtagtgatataatcagagatgcgttccagcatacagtgctcagaggcagctgtggtagctgtggttttctcatcagcctgtctctgtcatgttcctggaaacacatctatatgcttattgttatattcctcagataagttctgagaaatacaaatcgtcattgtttatttacttatatttttaaatcaaatttctgatttattcatgtattccagttcatcctaagatggtgatgtatgcctcggtattgattttgctaaatttatataactttgataaatataaaacacatatattttagaaagtttattaatgtataattgacatccaataaattttactcataaagtatttaattttatgcacttttgcatatgtatacatctgtgaaactattaccagagtcaagatagttaatctagccatcacacccaatgtttctttattttattttactttaagttctgagatacatgtgcagaacatgcaggtttgttacataggtatatatgtgccatggtggtttgctgcacctatcaacccgccatctaggttttaagccccacatgcattagtattggtcctagtgctctccctccccttgtcctccacctcacgatgggccccagtgtgtgatgttcccctccctgtgtccatgtgttctcattgttcaactcccatttataagtgagaacatgcacactcaatatttcttaatgccttttcattatctctcctttttgcctactctgtctgtctctagttgactcttgatctatttctgtcactatacattagtttgaattctaaaattttatacaaatggaatcatacagtatggattattttttgtctagcttctttcaccaaacattattattttgaggttcctccatattgttgtgtttggcaatcaatggttcatttcttttcattgctgagtattccatggtatgaatgtactacaatgttttttactcactcacctgtatgaatatcagaatatttgggtttgtttttagctactacaaaataaagctgctaagagcattcatgtgcaaaagttttatgggcatatgttgtcatttctcttgggggaaaaaggggatccaatagtggatcatgcggtgagtgtatgttaggcttttcatgaagcttcaaaattgtttatcaaagtggttgcaacattttatattcccaccagcagtgtataggagtttcaattctttgaggacctcaccaacatttgccaaggctagtctttcaaattgtagccattcttataagcaggtagtatcatctcatggtaactacaacttgcatttctctaatggctaattttttgaaagatttccttgttacagaatcctagattgacagatttttttctagtagtttaaatatgtttatccttaatccttaatcatcctttcatcctcatcttttttctttctacatgtttcctttttttctcaattttcaagatttttctctttattaatggttttgggcaattttattataatattccttggtgtagttttcttcatgtttcttgtgcttgaggatcattgagcttgcttctactattggtttatagtttttatcaaatttagaagattttaaccactgattttcacatagttttctgttaaaaaattatttttcttttcatgtttcattttacagagtttccattgctatgtgtttgagttcactgctcttttcttctgcaatatatactttggagttaatcccatccagcagatttttaatatcagacattgtagtttttatctccataagtttaatgcttgtttttaaaaatatctctcatgactcaactgcttgaacttatgaaataactactttaatttccttgtcaattctaaaatttgagtcagttccaggttagttttgattgacttatttttctccacattatcaattatatttcctgcttctttgcatgcctggtaatttttattggatgtcagacactgtgatttatttgatgctagagatttttggtttattataaatatccttaagcattgttctaggtcacagctaattacttggtaacagtttgagccttttggatcttgctcttatgacttcttaggtggaatcagacccacatatagactatggctaattatttcccactattgaagcaaggctcttctgactctaatactctgtgaattaggaggtcttttagtttttctgttccctctgatctttccaggtggttcttttcctagccttgggtaacttcttcacatgcgagtgttgaatacttcagggagaccatctgcagatcaccaaagttcttgatatattctggatacatgtctttaccagtaatatgatttacaaatattttctgccagtcagtgttttatgttttcatgttcttaacaatgcctttgaagtcaaatttttaagttttgataaagtccaatttatcattcttgtattttaaggatcaagctttggtgtagttaagtgttatttttaagaattttttttaaactttagctagagtagattttgttgtttgcaagtcagaaatctgactgatatgataattaaagaaaaaggccaagagaattgcattttcattccataaattttgaatctaaaatgtgagtgagatactctggaatcataacaatttattctggactcatagtttctgttgcttgtctttgcttctgtcaaccagatggtgctattggattggctaccaaggaacatccttatctgaatggttgaggttgtattgatctaaaaaatctccagagataatagtggacagttgctatcacttcttgggttcatggacctcatcaccatcttatataattagaaagagcataccaccatcttggtgagacctcaaatataaaaaagagcaccctctaattaaaataccttatgataaatccgtgatttggtcttgggttcttatgagcaggtaaaagtactctgttgtattggaaatcatttgattgtgaaaaatgttctgacagagatcaataattaaattaagtgaaaaaatatattaatccataattaaggcagttaatccattatttattgtaaacaacttaaagctaccatggaattccaacatctgagcaaactctggtgaaataagaaaagaactgaattagaaaatgggagatccagggtaaagtcctggccctaacactaactagctgtgagatactgggcaactctcttttcttatctaagcctctgttttgtcatctgtaaaataagcatgggctatgtaatgtgaagttctttatgttttttctggacctcactgtctgtagagagaaccaactggaaataacttctttgctgccttaaaccagcagactttattttaggacagagtgagtagtttgttgctaacaactttgggggatactggagaaggaataacccgaaaaggtaagttggttgtggcatttgcacactttattaatttttttgtataatgtattttgtattaatttttttgcgtaatggtgcaatatatccatgggtttagtgtaaccattacatacataatgtacaatgtacctgctaaacaatttctcctctctcacctccttcctaccctcccacctttccgagtctccagtgtcttttattctacactctgtgtccacgtggacgcattatttagctcccatttgtcaatgaggacatgaggtctttgattttctgtgtctgagttgtttcacttaagataatggtcttcattcccatccatgttgctgcaaaagacatgatttcattctttttatggctaaatattattccatggtacattttctttatccaataatccaaagaatgaatgttcatgcaggcacatataaagtgcttggcattatttcctgcagtgggtgtgcctgaaggtgaggcagagatggactggaaaagattgacgtttctttgaccagcaatgctgaccctttgctctttactagaggcagtggcttcactgtgcaaaacaaatgtgtgcttagtggagggtacctgaggtcaagggctagccatatagatgactatgagggaaatgcagtccgcattctatgatagtcattactttttgtatattccgcaaagttttggtataccatattaataaaacagcatatgcaaaagcacctaccagaacagctgtcagaacgcaggcactcaatgaacataacttcccttctcccagcttccccatgccttccttctaacatgtactatgctctttatctttataaacctctggagccctcttatgggtctctgaccattcagggttctcagtttgaatctgccccaggctttgatttttttctatagttttacttttataaacatttaatgactgtatatatttttctttcttgaacctacatgatatctagctagtgtaaccaaagggcaatttatttagaaacaaggtattaaattaacttaactaatatttattgaatgcgtactgtatgctagttaatattatagtgatgagaatatagtaggaaataagattagtcaaagttcctgtctccatggagcttataccgaaataatgcaaagtaggactataattaagtagtggatatattatttttgtcatcccaaatgtatttatctgtttccttattttatggtttctataccccagtatttctatggggaacttgtcatccttatttgattggagtcttagtgggactgtacctaaaaatactccaatctcccttagctaattcatggatatagtaaaccatgctggaccaatcagattctctgttaggttgagtaacaagaaaataattggagtgaattcagctcaaagatggcactcagacaaggtcattgactcctgtttcctagaacctcagagctttactagttcttgttggttccaaggctttattttttggctgttctttctgtgcaaaacctccttcagtgtttcttgtttaagttgctgaatgtacttttgtgttgcttggaatccagtagtcctaacttataccaaatctggtaaagtaagaagtattagtttttacaatctctattaattccaattcaattctcaggtttcatccactgaacagacaggaaattaaatctaatttttattggaaggggatcctcctttcccgtagtaataagaactaaggagtctcttgtcatcatcagtcatttttctacttgggtcattattgaaatacctattatcccagcttctgtgccacaccaaggacaaggaaatctttggtatggctgggtatccctgagttaggcttcagcttctacaggcacaccatgtaaaacttagtatatataagcatatataatttctctgaaactttgtactttccagctaattattctgatgcaaaacctccctcagacaattaacttatctgagagactatgctgtcttttaagaacagggcaaactatcatgttcattctgtcttgttcactcacctgtcctctgtaaattactctggatttgtgtactgaactcaagggaacaattaatttattcattcatttagcacgcatttattaaatttttcatgtcttccaggtcctgcatgaggctttgaaattataaagaacttacagcttctgcttgatgatgactcaacagttagagtggggaaggtaaaagtttagtgagctggtggctaaataatcaaataattttggcagtgataagggacacaatagaggtctaaaagtaggcataatgggagcacagaggaagctcttgagtcgtttggagatgtcataccagtgatggcttgcaggagaggatagctgggctgagccttaggaaacaagtagaaatttgcttaatatacaggtggagtaggagtagtacattccaagcaaagtaaaatggagagagagagagagagagagggagagagaaagagaggaggaaggagaagaaggagcagcagtaggagaaagacaaggacaaggacaaggttgggaaaaggagactgggtgagagaaaagaatggcacgtgcaagaaaatgcaagcagtcccacatgactggtatgactgcaatgaagagtccactggggaactaatgggagatgagcatggaaagggaggcagaggacaaagtgtggtgggtaaagaatcagggatgagtttatgtcctttgcagggacatggatgaagctgaaaaccataattctcaacaaactaacacacgaacagaaaaccaaacaccacatgttctcactcataagtgggagttgaactatgagaacccatggacacagggaggggaacatctcacaatggggcttgtcgtgggttggaggggtaggggagggatagcattaggagaaatacctaatgtagatgatgggttgatgggtgcagcaaaccaccatggcacatgtatacctatgtaacaaacctgcacattctgtacatgtatcccagaccttaaaatatattaaaaaaaaaaaagaatgagttttataaataggctgtcctgggcgaaaattccagctttatttctttggtgccatggactcaaggaagttacttaactcagttttcttatctgtaaaagagagaaggtggtaatatgtccgttttaacatattgaaaggactaaatggatttatgaatgaaaagcacctagcatggggcctgccgcatagtagacttcaaagacatttttctttcctcacttccctgccacccctaccccacacaccctgaaatctatcacaagagccataaaactagaggttactgttaaaaagtgcttggtggatacatttgggaagcagtaggaaactgaagagagagaatgaagctgaattaaggagagcctttgaatgggtagcacagattgtacttaaaaatcacaaagatttaaacattactcaattgcaagcatagtattgaaatgaaaacagataccaatgatacaaattgctataatcttgtcactaatcaatcaatactgtaatttatctatgacatttctatttggtaaatgccaaaatctctattttcagtttttacagatttgcagaaatattacgttggtgcaaaaataattgtttttggcattaaaagtaatggcaaaaccacaattagatggcatatgtacctttgaatttttattaaaattaagccttgatatttttaagttattcaatagcctttttttctcttctttatttctttcctttcctttaataatactttgctgtatttctccacatatttctctatgttcataagatactatataaacaaaaacacctatactaagttgatcattttcctagaaatgtaggccagtcacatacatttctttgcaatttacttttcttacatacaaaaatataagggacctccagctaactgcaggactcccataagatggaacattatgcacatattgaaaactaaacatgagatctttagatctacaagggatctaagagatcacctagtctagtggttcctgatgtcacctcagtttaattattttcttagtgggtagagattttgaatgtgagagaagtgttgaaagttctattaaatattaaactggcaatgacagaaaaatagatttggaaggagtaacctggggccatctttcaggtccaactttaatgcaatttcctcaggaagtgtttcctgatatccctgaccaggataagtccctttctgagtgccttaatagaaccttctatttgttctttgttatgtttactagcataatattaataaattatttgttattgtccatcttatggacacgttcaatgtccatacttacccatgaagtatcgtggtaagtatgaacatgatacttcattacctaatatattcttgacagattaaaaaaggctgaaaaataaatgaataaacagagaattttttgtgggggagaggcagtcatacagctttaaaatttgatgcagtggagtgggagaaggttgcatcaggggctcagagactgatattttccttgtgaattcatgacacttaatgttaaattccctagcatttgaggaacataagcttgcatttattggtgttcttaggaatgatcagactctctgtatgaggttcgcagtaaccgaatatatagggatattgttaatttaaaatagaagctgtctctttaaagtgcttacatcctcaacacaagtcaccctgtttgtggagacttgaagtagtactcaattgcttgtttagtgggcatataattagaacaaatggaaggtgatgatcttgaggcacattttatctaggttgccttgtgatcagataaaacatatttaccccaccgcagaaaacagaaacttttttagtgatccaattgcagtctctctgatgtacccagaactactttagatccctataaaaattgtttttacacttatacattatttctttgtgtcaacagcacaattaagctttctggtaatattttaagtaaaatattgtacatttgagagactatctcctctcattatgtattgatttaattcatgtaatgctcaatcttatttctttttgtattggttaaggttcttctggttaaaagtaatggaaatcaataagtcaaagaaaaggtaatttattggaaatacaccaaggtagctcaaagaagggctggattaaccaaacaatagtgccttaggaaaagcagaaacagtgccaagtctggggatctcagtggtgaaccttgtgaactaggatgccattccaatggcatctactacgttgttattcatttagctcctagttcatgagtgtgggggaggcagatctctattttcctaattacttctgactataatagaaaaagatcaagaggatttgaaatagagtacagttagtactaggaatcaagacaactttttttttttttttttttttgagtagcttcctcggaaaatttgacaggacattgtggctagctgactatgagacaagaaacaaaaggatgaataaaaaacgttaacttttacagcatgagttattgagaaaatagtagtgtcgtgagtaagtttggaatgtggagtgctttttagggggaggagattattatatgtttggctttatgcatatttgaatgcaagatggtgagatgtccccgttaagatttttaaagggagttatagtgaaaatagaactgggaatataaagctagtgttaggataatcatgagaaagaaataactctctctggagctaattttgtatgtatttcactcttctcatttctttgaacataggaaccaagccttaatcatttttcaatctcctaaggcttagcacttagtaggtggaactaaaacatcatttagacattaaattgagtgactcagagagaaaagaccagagaaccaagaataatttccactttctcttgggacttgttcaaaatgttgtcttcctttttaaggctctgccagaataaacctattttagagtctacctcttttgataaccagagagtcaacctgcaccatttgttttctccagttaggtttatgcaatttgggaaaggttttttcatttaccttctcttggttgttggactctttgcattacagttgcttaagccataacattagcatcttgagagaaaacaatgagggattcatttcagtctgcattttcctttgaatctgacaaaaagaagaacaagtctggaaagatagcatcccagaatatttttgcttactcttcactatttaatcaatacttccaccagaagtaagacagaatgtcttacttcacattagaagtagaaaccaggttagacatcctgataataagtgaccttattgtggagatggatgaggatggataaaatatggattctatttggtttcatcttaactgcatttattctatccccattttattgcccattcattgctccatgtcagttcaattctattctatttcggcttgagatatacccacaatataatgctagacatttttagtcaaaagcattttcaaatcttgtcaccagattagtcttctcttcttatgcatttcacgtttcctgtagtaaattatagtgaatttaaacttgtaatggttttcaacttgtagaccttaaacattttattaaaagtgtaatataatatcttggtaagggttaccactttataattatttccattgataggaaagttgattctgaaggcaacttagtgacttgcataaaggcatggagtgatttagctaaaagttggacaaagtgataaaatccatgtacaaatggcttgttctattgttaagtaatacagtttttgatgagtggagttactgaacttttcaaatagattagactcttctgatttggaaacgtatttgtggaaaatgccaacaatttctaaatgattttttaaaaattccattgatttttaatactttatactttttcttccaacctcaactataaaaataaaattattcactattttctatcaaatttcctttcttatgttgcaataatagccaaactactgagcattgtgtagaattctgctaaccactttacaagagagagatttacataagattcttttggttctggcttgacgtgagggattaagtgttttcaacactgtaaactcatccataaaacaatgttgaggtgggtataattattttcattccttagatgaagaagctgaggctgaggaggttattcagtttaacctaaggtggtagtcgtgagtggcagtgataaaggcagctgttaaactgagtttaagaaacttactgcagcatcgtaaatactgcctctctttgtgccccaacttccattcacactctatttctgttatgcatgtagctaaccaccacctacttcaggatcaactggaggacttgttaaaaataaaagatgcccacctctaactgtagcaatttagatctggcagatctagtgtggcccaagaatatgcatttctaataatcattccttgcagttaattatgcacagtaagcttggacaacaattgccttagttaatatcagaaaaatgttcatgagaaagaaaactttaaaaaatctttattcttaagtattgtttaaatactttgacaaataactggtaatattgccctaaaaactcttgccatgtcatcagttgaataaaactacaaagtttgaaaactctccaggacgtgacttaacatttctgatctctaatatagaaaaaatgatgacagaaggcacaacttgtcggcaggttgagagatcatggccttggggctgaaaaccctggggaatcaattttagccatagagggcaaagacgggggaaaaaagtacgagctctggagaacagataattctctgccagtttgtaattttgaacagtactcttctgccagccttggctcctgtggtttctatttagcatcgtgtaatggtctctcaattgtcaagtgatttactagttattttaggatttctgtttctttggtacttattattccatgcctactgaaaaactgaacaataaaagtaatcaattgggaacattttaatgaggcaatccaacccaaagctttgcattcaagtgtttgttcaaatttgagggggttatgcctaccagctctgttttacttggcctactcaatgagaaaagacaaaaaagaagagagaatttctggtaactttgagctgcagaagtaaaggtcgtttatcgggaggagttaatagtagaatgctctttggacagatgatgtgcttagattatttacaatccaccaccaaaaaagatttggaaacaagattataatttgccattgataggaggtgaaactttagctagatggtaggatctcctggatgttaaagtttaagtacacatggatagtcaaaacgctattttttatgtttctttgtgtggtacatggttttctagactgcattattcttgtgaggtgaacaccttgaatacagtttttttctattatttgttgggaaaatgtatacttccatgttaagttagcagctcaagtttcccaggtcagcgagagtaagattttctgattggcttacatgatgctttcttccaaggatgtggagtactgttaactctgaaaatcacacaattctttggtattcttttaaagttaggtctctgattaacactacatttctgcatcatggtttttttatttaggggccctggggtgaaagcttaagcatttcattagtcttgaccagatcacaaagaactatgaggcattttagagagcatttaaataattttggagggttattagagagttcaaaacgttaaagtgaagcaacaaggtctgtatcgttgccaaatttcaagagaaaaggctaattagtctttgaccttggagctatttggaaggggaatgtgttgcttggaatgtattagattaaaaattattctgaagaatgaagagagcacctgataaactactatatgaatggctttatacttagcagttctaaattccaaattactcttgtttttaaatagttatacataaatctgaagtaactgcagatttttctgtttctctactgtatcctcttaggactagggtaatgactagaaagggaataagtatagcaatagctaactatgtctttttttttaattaaagtttttttaggtcaagaaagataaccaaatgctttaaattttcctgtagtggtatatgtcccaatgctcaaagttttgaattgctctattaaattaaattactcactagtttcgaaaacattggtttagaaaataactatttctaaataaacatatgtgtttaccagtgagtttaatgccaataaaacagttcctattcagggtgccttatatctggtaagcagaactaccaactgggcagagggccaacccacagtccaaatgggaaatattttttaaagttttgataggacacagtactcagttttaaagatcatactctgattatgattgaccgggtctcctaggttaaacaggtcttcaagaaggtgatcctgcaagaactaatctcagttattatcaagctaatgtgggtagtggacaacaccgtgaaaacaaggggccaattaacttgggaaatgtggggaagagcaacggtgagcggggagggaagtcgctttacaggtgtaagattttcttggagagtagtgtgaccatgaaggacagggaattgccacctggtgaggtctatctctgtctttcccatactacttcctatggatgagtcgtctggactcaaagaagaccttaatccatggaaatggtctctggttttctgaagggttaaatgtagatacagtaagggatttggagaattgaaatcccatgaatagagtcttgagattgcaaaaataacaacaataacagcaaacagtagctaatagttctctgacactatatgctagacaccattgcatgcactctgcctagaaatcacccatttaatcttcactacaatgctatgacacagataatatcattattctaattatacagatggaaaactgaggtacaaagagggtaattaggcaattttcccaagttcactcatttagcaagtggtagagccagaatatgaaccaggaagtcaggctctcgagtctgtgttctccggtacaagcttcacaaaggagggcatttcctaagacatatttgtaccagttgaagctgtgcatatcaagattcattgggctgtaaacagtgataacatgctttttatctgactctgtaaaactataaaaactcatattttctggaaactagtcactttaagtaattcctagttttgcagtttagaggcttcttggatgatccctacagctgtttctggaaggaacctgagggatcatgcaccagacagtggcctaccagggggcattaatcaaatgatcattcataaacactgtgggagcaagttcatttcagagtaatcagaaattatcttttgttcctccatctcttcaaaggaaagccactgggaaacagggcaaccaatcactagaactctctccacttggtttaatgagacagtgaatcgttgaattaagccagtgtccttaagctgcccttagttggttgctccttgattagtcaaagtgtaatttgagtgatacagccatgttggatgttcctgccacatattctgatgagttagcactctgttgctgctgtcacacagcttcttaaaagaagtgtcaggataccctgtggggaaataagcagtgtttcgatggcaaagagactgctcgcgaggggctactcatggatacacatgttgcttaggcgtccagccagccctgcagtgattgatggatgttctgctcccttctggtgtatcttcacttgtgctgggaaagggatgaagggcacctttgaaagaggaggaaccacagtaatcacttcatctctcttctgcttaatgcaaacttactctggaaagataaatgactatccactcctgtaacaactcctcaaaatcattactatatattgctgtgggccagatttgtgcatttctaggattgtcccactgtggcagttatcggctgcagtatgtagcattgattgcatgtttttgttaacttgaaagtatcttagaaggaataagcagtaaattttgaagaggtctcagtgaatctacttgacatggaaatatataattgatgagacattgtaatgggtttaaaatttacagtcataactcaggtatacagaaatgaaacattttatttttctgttactgaacttaggtcaagtccccatttgttcagttggctgaaaacagttacttttgctgtttcaatttaatttagtcacatacagtttattcagtcaaattctacgttctcttcctggtcccttctttgattatccttatagatgatctaagttactgggtggcttataggtcatcctggcatgaggggaggagtgtcctattccttgggtcttctttggtccttgcagacttttgctgagacatagcagttctcttctagcttggggacctcatgtatagcatctggtgtactgggtctgcatgggcctgcctaggcctctggactacatgctcaggctctacacctcatgccctaactctggctctctttcggcaacaggcccactgagcacttccctgtctttcctcaggggatgctcaagaactcatggctactttctgtgcagaaaatagactctgaaactctaggaggcttcttaagctcatctgcctgaaacataccccagcttttgtggtggtccttctgccatgcctgccatgctgctttggtgccatgctgagtgaggggttttcccaagggcttgtagtgttttctggctatgctttgagagcaggttaggcacctacccctgtcagaatgattcaataggctcaatctctcttaccccgttcccctcccaatccctccacatattaaaagctttctatctacctttttgcatttaaaaacctcatgacctcatgtttcatcccttctttaagttttatactataaatgctatgctgaatcatttgagctctggctcattggaacccacaaatcccccttttcacaataataccagaaagcctagcattccaggtttgtctcagctactgactttaaaaaagccagatttgaagatcaaagctgatgaatgacaatgtgattctctgatgtatttaccatctcctctggaaataaggaatgctggtgtttgtttcaatgggtaaggtaggaaacacaaggactcctggggaagaaaatacatctgctaatatttcaaaaacattatcccagctatagcactttctcttttttactacatgtacttaaaaaaagtttagtcccttctccctttttccttgttttttttttttttttttttgataatgacattgaaacttcctcattattgggtaaagttctacgcagcataactcctgcttttccaagtcagattgctgcccacctacagaccatctaaagtaggtgccaactgtgagggaggtgctattatgatcttcatttctcagatgagaaaacttatttggagagattacatccagatgcactcagctcataagtgacaaagttgggattcatggtcaggtctgttgacattatcctgccatttccaatgcaagtctatttcagacttatcatacatgtattaagttaaatccatcctgaatagactacatggagattaagttcctgcaaaatgactttatgtatacacaatttttaaaaactgcatacaagttttaacttggggagaaatcagttctctagttactaataacctcaatttttttttctggatagttttaaatatatgtattttgatttaaatagtgtttaggtacttttttttttttttttttgagatggagtctggctctgtcgcccaggatggagtgcagtggcgtgatctcggctcactgcaagctccgcctcccgggttcacgccattctcctgcctcagcctcccgagtagctgggactacaggcgcccgccaccatgtccggctaatttatttttgtatttttagtagagacgacagggtttcaccgtgttagccaggatggctacgatctcctaacctcgtgatccgcccgcctcggcctcccaaagtgctgggattacaggcgtgagccactgcgcctggccgtatttaggtacttctttagatataagccccatggattggcaatccaaattgagctagtagatcttcaaagaacactggaactacaaataccaactgtggatatttactgtcataaataacacttttgtagagaacactttaatttgcctgatcttatatccattaagagagaaatgagagtaagagagaaagagcgtaagaataaatcattggctggaaaccttaaaaaatttagattacttcttagattaaagttaaatagtaccagataaataaacatgaaaagaaagaagcctatgtggtgatttcactgtttcacatggtagaaacataatcagttgaaagtcactcatgaatttatatcatattcatgaacacaccagaaaaccaaaaagatataaagtccaccattcacttccttaatgataccagatgcatttaaataggaatttcttaaacttttgtactttgacatgctgataagctccagaatgatattatatattagctaaagatgaattatgggttttgggtttccatttccttaaatcaacagcatgttcagttacagcacattgctaagggttaattttcaaaccaatgagtggtgagaagggctagtgaaaataaaaggggaaaaacccaactataactggtaaaactctttctatgtgaataatattttttcttttgcatttgctgtgtcttctggaggaatgacagttgtgtaattcagtctggttggagagacaggcatagggttaataaaggatttgtgtatgggatggtgtactctagcatgaactgccatcctcctccagtggtgtgtctgccacacataagtagcataaataacatctgccaaaacagccctctgaagtattaagcactgacatacccgaatgctttctaggtgttacaggtgtactgttcaagtgctgtttaattgcagtcttaatcaaatatgatagcctgattccaaggtgaatgtcttataccattgatttgtagtaagtcgccacatttctttgaacagtgtgccattttatatgagaattataaaacagcaatgattattttaggatcagagatgttgtgattcatcaggtactgttgatggatgatgcatttgtgcttagtctggccttgcgcagaggctcgagtaatttgttatcctacaagacatgtgctgtttcctcttccatactactccccagtgctactaatattttaaggctaaagaacaacactgtattagatagaactacaggctatatgtaatgttaaatatatgtatttgtatatatgtgtatatcctctgctatacagatcaggtatcatgctaaaaccatataactcttaactgcatttttctggtaattagcaatggattatcttcccaaaaaatatgggttcttcaatcctcctggtcttggggagcacagaatgattcattatctcttctacattagccactttgtttgtggcaggatttgaaataggaatataggttgtataattacttaatgaaattcaaaattaataagatgccattttcagagttttttatgttgttctaatatgttcttcaagttttaaaagccattataaactttataaattcctatatttcctattataataaagtctgtatccttatttctttcaatatttatgcagatacatacataattatagtgccacatttgaaatatcctacttttgtatattacagattgcatgaaatagcccagaatggaggttcagttgatctttaagagaactcaggagaactgaattttgtattagctaaacttatttaatatattaaaatgatatacttatacattttaattttaatcctttacttcattttcttttttaaatagaaattatcttgtctacaatagcaatttctgtattggtgttttctcaggtaatgacattgatccctatttaattactattgcataattaaaaatcagccctttgacatcagtggggatggtagggctacagtgtacaacttattaactttcaaattatccaaaacatttgcttgcattttgttataatttctgtatgataagcatattggagataaagtagaaaataaatattatatattatcatacttttagatgaccaattttagcttcatatattttatcgagtttcagtaacatgagcagtgtattgctttgttcatcatgtgaaaaaattgaaacattacaaataagtttaagatcttcctatgggaaaaaataatttcctctatcagaggaaaaatttattactattatgataataccccttcagacctttttctagtcacttacaggtaaaaattgtagtactggttggtacatagtgtattttattaatgttttactgcgtatattgttgtataaattgctttccgcactcattggcatgccttagaattctttttatttaggcttcatgactaatttgtagtggaacctcaagaagatcacttatgtgcttcactttccacatatgtaaaatgggaataacaacagaatctgcctcatagtactgctgaagggtgacatggggaacacctgtgaggcattcagaacagagcctgtcatacaataaatgccatgtcagtgtttgctcttattctcagtatacagagatctgctttgatcttttcatcttctgcaaaatattccacaaattggcatattgtgttttgtaataatctctattgattattttcaagcaagatttggaattatccgcagtagtttcaaatgtacaaaaaagtaccttattttatttattttttaaataactgatctgatctacgagtctaatctggtaagttttgtcttgagtccagtaatgcagtccaatactccatttaggtaaccctgtccttgcttggtcaatttgttccacttttccaagtttgacctgcttaccctattcctcttcaagagggcatctggttgtttagtttacatgatttagtggtgcagaaggaaagggtaatcagattgatgtatcctctgagtcctccttgatatctgcagagcagctgagctggtctgctctctgtgctgttgacatctgctctttggggcgttagggggtctggtcatttgtcccttgtctgttatgatctacctgcagtggttttctaccttgtccccaggcttcttaattcttcctgtactctcagaacctctgtgttgtcacaaccagacttgggttattttgggtccccagtttccaggccctgaatgccatgggctctgtctcaggaataggtatctgctggcctgctgctgtcatttctactacattgctcctttactgccttaaagagtggtcctggatcaggggttgaaagtggaagtggaaataaaggacgctgatgtgacgtctgtgtttccattcttcttcctaccacttcaccagatgtgaaaaattcatataatctgaatcctctagtttgagttatgataagttaaagcagtttaagaatttaacgaactcccctctccctgattaaatctacttgttagcactgtgttcttactgcaaatcccgttgccttgccagaagataaatattaactttttctttctctttgccttcctgttgtaataattccaaaccacccaaaagaaataggtgagtttgtggagaaggtcagtaaaataatttcaaaagggaaaagaacattcatgcatttaaatattattcccactggttcatttatgctgcaatgaatatctatatatctatgtatgtatctatcattttgtgcacatgttttagtatttttctgagtttcatcctgaaaaaatgtaattgctgtaaggtatgcacattttacatttcactgtataatgacaaatcatgctacaaagtgactagaccaatttatactcttgctatgagtcactgagagaattctttactaacaccagatattttgcgtaacttattctgtttaaattctatcagcaaacctccatagtaggtgtattcccattttgtatatgaagaaactgaggttcggagttaaagcaacttgttcaaggtcacacaaatggtaagtgggtaatttcggaaccttttaaaataaaacatagaagcctactatcttattgttccattctagaaatatgtctgtgtttataatatcgactactttgtattattttaaactttataatattgactactattattttcttcacatcctagttaagaatctaggataaaatggaaaacgatatcacgaaatggaaaaacaatgttattccttagttagcttagtttaaacacctatttaatggtcaaaggcaagtagttgacctcccatctttttgactcacagtcattagttacacaagaaaagcagaacaaaacccagctggatggaggggtggatatgcaagtagctttcacactaggaattgtgaagcctgaggcatagccccaagactcagatcatcgggagtgcactcagtccagagggacaaatgttcagagtctgcatcacctaatattacaagcatctttattgagactgatagaagtgaatttctcaggtcagaaaacagaagagctcttttagctgagttgtgatatttaaaagtctctcattttgaatttcttgcctggccaatcaaactgtcctcccagaacaaattgttggataatgaaatgcatataatgtagcttgagagcgctgtcccatttgcagcactggcttcagcctgaggcacatctctggctgctcctttctatctataagttaaagcaatggcctcagcaagcagtacactctgtacagcagctgcaactcgttatcggctttgtccagaataacaaacagaacaaacacattttgcaagggcttttacccctcttatgtagagaaggaggaattaagcaatcagtgaaatgctgattgatcagttgtgctgactaagagaagtccaaggccacattagtactattaagccctaaaaaacaaagcaaaaagaaaatgttcttagaactttatttaaaccagtatttctgtgatgtgaagtacatttcccccaaagggaaaaatgggaaaatatttgcatttcacttagtacactttactcatccagactgctttgtaatgtaatgatggttaagtatttttacaaagataattcatgttttttggcagattttggttgatcatggagtatcagggttgtgtgaaccaaaggtgtgatgcagagcagctttagtaaaccatcccattcctatgccacccgtttgatttcagtaccaactgctgtggccacatctagaccactctttaccagaaactgtgccaccttcaaaattccagcatccttttcccctcctcccttattttttgatctcatatactcaagtattcttagtgtaacaattctttgagcattctttcttatctagcttaaaatctagggtctaccattataatcattcctttcaagataaccttaacttccacaccccaatttctaactggcctggcaaaactcagacctttggtgcaaaatcctccatctctatgcctgagcccttgtgtttgagaatggctgaagaaaaccatgtgcatggacattctgatgtcactataaattcatggtcacggatctcaaatgggagcccaagactactggctttcctgctgtggttgtctaatgacagcatgatcttactcttcacagatattagtttaaactctccaaccttcaattgaaaagtctacatcttactttattagaaagtagaaacaatcaagggttatgctcccattttcacactaccaagtaaacaaaccttcagtaagagaagatatatttcctatatctcctcctaccctcctgttaaaagggtgcaaacgtcccccctcctaacaaaaaccaatccttcttcatgctctttagatgccgtgttgtctctctttctcaaagtcttcattttttggttatactctttctctcatgcaaatttttctctctttttcaagtagagcaggctcagcagcctacaaacgtgtcttgggcacctttcatcaaaaaataaaaaacataaaaacaacaaacgaaacccttcttggctccacattctcatccagtttctattctttcacttagctgcttttcttctcatgttttgtctattttttaacatcctagtcactctctgatctacttcagtttgacttctacctccatcacttgagtaaattcaatacatggtttcaagtatattctagccctagcctgatccacagggaaggttctggaccacaagcaacatggcagagttgttcactcttgaggtaaaggagtttggcacctcatgcccctataatggattaaagaaacactccttaatcggggttagtccctgggaaaggttttaggtgtgagcaattagcaaccatcacccacagtggctgggagaggggggcactagcccaataaagaggatctaagtagtgcacccaagcaggtctaccacagttagcttcctatgtgggctcacgttgcatgcagtgcatctctatacagcaattaatctatttcataatattaataaaataatttcactttccatgttaaaatccttcaatgacttcctattgcactataaatggcaaatcaatatgttaacatgccctgccaacacctacagggtctggggtctgattgcctttcagatctctcctgataatctcccctgcttggttcaatatccttctgtttcaccaggaagatatcatcaatttccagctcaaagccttcacatatgatgttccttctggctggggtgcttttcctcccacatgacccatttaattaatatgtatcattcacatctcagtttcctcggactgttttaagcatccaatctaaattttgttctccactattattttctagcaaaacagcctactttattcctgcagagtttgtaatcatatattgtaataaaatttgtaattatatattgtgagattgattactaagctgtcttaatatactgaaagctccaattcatttatatttctttagcatctcccatgaggtatcatgaggtttgggaccatgtcatttcatttcaccattgcctaatggggtatctggtatgtaataaaagatactcaacttgttgaatgaataaataaatgcataaatgatgaataaattagatacacaaaattaggacgtcaagaaagaatcacttccccccctcccgcaagttattccttaacaattctcctagggctatcagcactgggacatgagaggtttaatcaaatttgtgttcctttggtgctctcttctgggatcatagggcttgatggatattctctcattaactcgtacacatccctgccatttttgtgacactgatttgcgcagtttttagagaaactgggaaataggaagattaatagacttggctgaggatagaatgaggttatgacagaaccagggatagagtgtgcttctacttattgactagcttagcatgctgcacacttgttagcagttaaagaaaacacattgggaatcagtccatgtcagtaggtacgtaatcctggaaacttccttctgaaatgtattactataaatattctttctctgcacacagctcatttgatgaggtacatctttaggccaagagctcttcttgatgattaatcctactcaattttcttatgagaaaatgatgcacacaaaggttaaataactcagccactgtaatagaatgaattcatgtcaaacctcagctctgaggcttctagttgacctgtacaaacatgtagctgttttccatcttcatttcaagaatgttttatatatttaatattaaaactcctaattctgcttgttgctgagcttaactctatgtaacatttatatatgtaaatattacttgaaatagttttaaagccacaaattattttcaactggatttaattagaattttcctcgtactagtttgagagggtagctattccttgacaatctttttcttcaggctgaaatataaatgcagataaaatttggagcagaattctgccagttaatttaaactggggtatggcattctgaagtataatataataggtatgtaaaaatggttgttatatttagtcttaaagtttaagatatttagggaatgtatttactgaggaaatacgttgactttgagaatttctttatggagttgaagtgcctagtacattttttttttctcctcatactaattctaagtcaggtggtccaacaaggcctctcatcctattggtattacagtatgacctgtctcctgaactttgaagccatttctttccttcagaggagataagaaaatgtgtcttatcttaagtctggaagaaacacggagcccagtatcaagggagtggagtagttcttttcccagacgtagcacagggtttttcaagcctgaagaaaaagattaatctccttaaaacaaggctttgttgacttgggtctggtcatggcaatcctgtttccagccatcctgtgtataagctctaacggtcagaagtttgtttgctttgattttgatgtggctcatcttttcttagctgctcatattcaagatttggaaaagaaggaacggtggtgagctgagcaattaattggattctgataaggagttctggagaaattttattattcctgagttttaaacccgtgtaactttaatataactttggtatgagcctttacattttttctctgtgtttttgtaattatattgtggcattcttattgggtgtggtagtagcaataaattataaatgtatgaatttatacattatggatttataatttcataagtttttgagattttaagacttactattttttacacgatgccttatgtatttatagcatttaatattaatctaaattcattttgagatatattttatcatgcttttatcttttatatgttattagaaagcacttggtattttaaaaatatatattaatgtgagatttcacaatttataccttgtctttgtagtcacatgcgtagaggatatttacaattttactcaagttaatttgctcagtgttgatcatcagaccttttagccagtattggctgggaaaaaaagtgtaattctttttgttctcttgagaattttttggatctaaagtgattcctagggtgtgggtcaacttctatgatatgaaagatgacatggaggttttttattttgtgaagtgcattaataggtgatcacatttcatcctgggagagctgctggagaggaatattgatttagcctgttatggttgagtctttggggtcttgagcttcttagatttttagttctttttgttattctttattgttcaatcttgagagtagaaaatacacatttttgtccacttctaagaataaaactgaaaggcttctcaagagggagcttttgagggacaagtctgtgttccagacttatttttattctcggatctagcaccatgcttggcatgtaaaagggctttaataagtatttatagaaggaattgaagaattaattattacttatggactatgagaggtcatggttgttactctttctaatttgtcgatattaaacagagacagtgaagatactaatttagatcacacaacgtgaatgaagcaaacaaaagcctaaagctttagaaaaatgaatatattatatttttaacttcgcactgtagttaagcagtgtggagctatttaatgatttcaaccaggaagatattaatgtgtgaaataagagtacgtggacagtatattaattgtatgatacaaacaagatatacatacataaagttcattaaaagagtatgatttcatatggctttgaaggattgataggatatagacaaattgataaaattgatctaaccaatatttaactttaggtttcttcatcagataaaatattgcatcattttatgttggctaagtgatttgcagtctatttcaattaattattctttatagtttttctctgtcaatgccatttaataaagagaaaacttcagcagacagaagttatatgatctttggcactattggctgtgtgttaagccacagtaaggttcagttacgtattttattgttttataatcacacatttctcctttgattcatttcttatctacaccccttctttcacatcctaaatattttctttggataaatgtgtagggcaagatgaagaaaagaagagaaaaaagtagtcagagcttgggagtactgaaacgctttggactccagccagctgccatcactgaggtggtgaaagaacaccgtagtataactggatggccctggtccctgccaggagtcaggatggactttcagtgttgaagagccatcttggcctgttactagcgctgccccacaccattgtgtttgcctaagagctgagccaaagaatttacatatgtatgagccaaggtctgaaaatagaagttaaaaaaatggtgctaaattgacatatttgctattttatttttttggtcagttaatatgataaacttttatttaaatgtaaacattattttaaaaagcactttgttttaaataactgattttcattgaaattaattctggcctctaagcagagttagctacaaagacaatttgtaaaaatgcagaaaattcagagtttaacttggagttgtttaaagtttattttcatatttgagtctgatatttcagttcactgtaatatttcaatttatttaaaatattatcaagacaaatattgggttaccttcacaatatttttttcatttttcttaccccatatattaaaaatgaacaaaaatgaaagaattatatagtctagtggatggcaattctcttggtacagtactcacaggatgtcagaagtgctttgatttgcatgcaaatagaaactgcattcctaaaagacccttaattgaagatattaataattttcattaggttttaagtcttttaaccttatcatatggatagaaaagtaaaagatgtgtttaataaaatgtcttttacttatttttatttgtcatttatttaaaggtttattagtgaatctgtttacctggaaaatgtgcaattctatttgcaaatttggagcactacatatatttaagagaatccttagtttctgttgggagtggcaatattttataactgggccttcatattcctatgttacagccctggtccctgaaagtcctacagctatctttgtttcaagtgtgtatgtgttataataagataagtgttaattagttaatcaagtactaattaacctttttaatttatagaaaaacagacatttatggacaagtaaatttttggggtcaaagtctttaataatttgaagaatgcagttatttttagcacaaatattctaatgtgaaaagaatttctttttctgagttatatatttttatgccattcagagtcactaatatagtactaataatactttttctattgtgtacctttgtttctctcatttgtcttacattttatgtctaatcatcatttcacaaaatttctatcattactgcttgacctcgacttctaacatggcaattaatttttatacacaaatttttgaaatcttgacagagtttttaacttcctcataccgagttctttgcttttttagtttacaagatgttcaagaatgctcttttgaaataatcaattacctaatgcaagataaattagcaacaacattacatatttttcttactatcaactgagaatgatcttgataggggcaagtataggttaaaaataaatgacatcaaaaaacaataccagaataaaacatttaattcttcaacactcaaaggcatgtcaggtattgaaatccaagtaggcacttttgactaattgttagtagtttgtagaattcaaggattagggttggcttccttttgtctttctttctcttcttcctccccttcttcatctccttcttgttcttcttttttttcccctctccagatcactaatcttctccaacaaatttttagcctatataaaataaaaaaaggtactcctgccctatgactcaacttacaaatctacaaacctggaggaagaaatagctctgtgatccattcctggggaattgcaataaagttttagggaagatggaacttaatgtttgtgaaagcacgggtcctatttccgatttccaggagggtggaatgtatcttcctgaatcacattccgctgaaaataggaggccatggaagaaatcaggttcagtataacaaattttctacaaaagggggtggagtaggaatgtgcgtaggtgacctgttctctacgtcattccagtgtaaactactgccccttacacttcacgaagtcggtaacttcaagacatgttgcaccacatgcttctctgtgatcctcaaatatgtttaatttaaagagggtccagtagtgtcctggcacatgatctggattgccatagataaccatctacctcacagctagggttgctctttagaatcttgcaaaatcatttgtttactcttgacaaaagttaagaaaacaagcccatcagagttgtttgttctgtcagcatgttagaagatggttttgttgcaatgataatcgttgtgcaaagaagactgatgatgatttttttttacattttcttaacagtatttgctatttagaatgaatgttgtctaattatttagccattttattttgtaaaatttatgttgtaggcatatttagaccaagttataagaaaatgcttcagccaaaattaagtgttgagtttgatttgtgtaattgttagtttctttactagttgttccatcatttacacaattatttctatttgaaatgcagtaattgttcagaacttatatttctatactgatgtctactaacagctttagatcaaatattaaataactcaagaataatgagatgatcttggcttacttagatatttggtttttatatctatagaacaaaggaattagaaaataattttgaagatttcatccagctatgtaaaactatctagggaatacatttactaggttttcaattttctacaaaacatctttcagcagaaagcaatcctgtttcctgatatacaatgtctgatacatagaaactactcagtacataattcctgaattgattattcttttggaaatcctagatttgatttctgaacaatcataaacatttaatggcatgaaattacccagattccatggttctggaatacataacttcaagcaataagatgcaagatagaaacatataagacattctttgctattttaggtaagtccagctgaatcagttaatcagctagaaacgtggctcacagatgaattagttttattattaggtggattactgaaaaattaatagctttatttccgtattaccttatcatttatttaatataaaacataataaaccagagaagttgtggttactttcttctgtctcattgttcagtttttactgaagttatgttttactgattttcacgaaatgcaaatatttctgagcatcagaaatccagcttttgctacctcccactcatgtattcttcccatcaaattgaatcttaaccaggtcactctttcctgttcattccatgctgttgcccctgttttctccagatataattgacatgctccaagaggatgaacattgcctaagacttgatttctggtcttggctttgcaacttactagctgtgtgaccttgaacaagctacttaattctctgagactcatcattattgtttataaaatagggatagcattagcttatttcaagaattgtttttaaaattagcaaggaaggcataccaatgcctagctcaggggatcaacaagtggcaagtacctcaactttcaggcaagatcatacttatcatcagtggagccaatagaacagatttatttaaataccctattttcacttactggcataacagcaagtggtgtacatatttatatatctctctatatagatgcagataatatactaatatattgtggttatatcttccaatgttttagtttctattgaggggtctttcttatttattacacaagaataataattattatttttttactttcaggaagattgaaagactttgcttaggactcctatgtgacatgattttaaatttaatagttagctcatggtcaaactccatttttagaattttaatttattcaatatttagctttttatgtgaacattgagtttcttttcttaaattccactctaagttctgctttctatattgggatttttaaattacagcttaacatgattaactttgggcctcttgctatgttttataattgctatatatgctttttggctcatttccatataaatcaatcctctacaacttttatttatttacagcttgtttttctttctctttttggactaacttacacgtgacctccctttgggtgcactttgtgtttggctatgtcttcaattttccaaagtcactgaattctgaatcaactttctaaggcatttcccactgttcttctcatttcacaaatacacaagaaacttcgtgaattcactggataatccactctgtccttttacattggcaataactcatttatatacattctttagcaaatgtgtatgcacataacattggcctagaatatatactccatgctgttgaattaacatctaacatgtctacttggtctgggagtagtgtcttttttaagcagaaattagcatgacaagatttactgtttataaatacatgctccttgtactgactaacttgttctccttaaggtgtttgcaaatggggtcttatgaatgatagctttttttttgttattctagaataaatcacatgtgccctgagctttaatatgtgaaaccaattttacaaggtctcttttccagcttcatttttcaccttcttttgtatcactccaaactttatgttatcaaatgttagattgataagcatattcatcataatttgatcctcactttctattcctcaaaatgccaattggatcttaatgaataggttttacttgattggatttccaaggatatctggttagtttgaaccctcatcatctaacaacatgatatctgtctgtcattttcaatccttgacatattgggaaggttttcaaacaactttaagtcttcttcctggccaaactttgaggaatcctcctaccagcttgtcctagtttctgtgataggagaaaatgtgtgccttttacatgggtacaatccacaccactttccctcagagatgccttcttcatccatatctttaattgtgaccgtgttccttgttatgatactaaggctaataaaaatcatagaactgaacccaattacttctaccttttatattctattttcacacatttctggtcaaacacaaaacagtagaactttcttcagggagttattgcacctccttttactctgaatttgtttgctctccagtcataccttactccttgctttaatgtatctcttcaaaaatagactttatagaattattgattgccaggttttttttttcatgactcctaagcatccttatttcctctcatgcttaactgatgtaattttatttgttcctgcttaaataatcatcactgatcaggcaggaattaagcacacagcaatccattcattcagtcatttttccagaagcatctcttgcatgcttgctatgttagagactttttgatagatgcaccaacttcttagagttgtttctgattcattacttaggaacatttcaagagggcagttggaagtctctgtaccttcaaaggaattactaacacccttattttctcttcattccaaaacctaagacctttattctctaagacatcctgttctcattttttttttcaatctgtagcaggtcttcccttgcttatgtcagtggactgtttaaatgaagagtggactgtttgagaagtggactgtttaaatcagtatagacacaggctgtcagtgtttctttatgtttcctttaaagacattttcgtaatgattaatataaatgagttaatggaaacaaaaatgtaaacagtagttgataaaagaatagtatcaattaaaaacatactgtgaagtattcaacttcaccagtgatttaaaatagaaatgaaagcaaaataatattttctacagcggagcaaataaaatgaaagataatacataatgttggtgaggacatttttaaagggacacccatatattgcactggtatgtaggtgagtacactctctttggagagaaatttgtaaatagtaatcaaatatggcaatattgacatgcattgtagcagcaatgaaaatggaatattttgtaatcatttaaagtaatgttttaaaagaactttgtaataacatcaaaatacatttaacataatattgcctccaaaaagcattatgcaagtcaatggcaattttcaaaactatgttctgagcattgacataaatgctagaagataatactttagtgttaacagagattatgtttgtgtggtgggttattatctattattctgtatttccacatttctttaaatatcaaatgaaagtgaatacaacctagtacttgacattttaacattttcaataccagatatgtcaataaggaattcataaaataaagtgccctgagggatttcacaggctaaatgcttctattttttaaaatgtattaatagaaaagaagactaaatctaaaaaaaaaaattcattttatcagagagtgactcataagtttagaaaacctttgatgacctggctcacaaagaatgtacttccaagtacacagggtccccagcctgatgtgtgtgcctgcattcatgcctgtcactctgctcagctgcgtgcagacagcttatatgaaggaggactgtgtacatgtggtcagagaagaaaaaaatgcttattttttaaaatgttttgaaaaataatctgtcctaaaagtgtaacatttccactaaattttttcatgtctgactttaacattccctaccaaccaactcttatagcctcaactcctttgatctatcctaatgtaaactccctcactaatgtgtaatatatttttttccagtttggttatagatttcagtctagcctgaacactcaagtatgaaactagccactattttatttattggctgttccaacctccattgtggaattataattgatggattttccaagtctctaattcagaatatttaatcaaattttccaaaatttctgccttctcctccttcattctgatgactaaagacatggaccataaaatatatatacatatatacatacatatgtatatgtatgtatatacacatatatatatgtatgtatatatacatacatatatatatgtatatatacacacacatatacatatgtatgtatatatacacacacacatatatatatgtatgtatatatatacacacacatatatatatgtatgtatatatatacacacacatatatatatgtatgtatatatatacacacacacaccgtagtttgcaagtctgcatctgggaccctttactgataaaaatgaaagcccattaaaactctcatgcccacatttctctctagactttagagtaggagaattctatcctagaattgttgattgttgacatttctatggaaaaacatgtttaattcatcatgctttgtagtcaactgctataaatggtgatgaagtcttttccttggtcaagctctggactcctcagtacttccactgtcatatttgattaaaacataagtgatgaagggaggaaatatattatagtattcattgcatgggtaccttagggtaatgggactatgactgatttaaatttattttgcatcctaaaaagtttccattagtgggtgcagcacaccagcatggcacatgtatacatatgtaactaacctgcacaatgtgcacatgtaccctaaaacttaaagtataataataaaagaaaaaaaaacttaaaaagaaaagtttccataatgaggattgagtttatatcgttttcttaattaaggaaagacaaccctcactacacacacacacacacacacacacacacacataaaaagacaagaggtgagatcaaggcgtaaactagtattggactaagccagtaagtactgcttctcagtcctcagttctctaggttgggagttttccttttgctattttcattctcctccaattcatttttcaatgatcttcaacacaaatttcgcctttatttcttgttcaaaatacttccatgactattatgaatactatttatggatgaaggctgaacattttaaggcatactaagtctcccatgatatggtaccttttcattttcccattctataccctgcatctaggcttttaaaaaatataccacatgacttcatgcctctaggctattgctcatgccacggcatcccttctgggttttttcccctctttatctacttggtgaatttgcatccttcagtataacacagctcaacataattctatgcttaaactttactgaaaatgcacaaggaacttgatctttctttcttattttccccattttatttattttcccattgcatttgggcaactttcatggcaccagttattttattaattatttgtataaactagtatgagcctattttgtttagctttctatcaccaggagccatgaagcactttgaaatcaaatactgtttgtacttgaatatattaagtaagcgtgaggacttaaattaaactttgttcctctttaaaaaaatccttaccccaactctagcactgattctatgttattgaagcttacaatctttatgtcattttctgtcatcttttctgttatgagaagacctaggtatgagtctattgcctttattccttggccttctttgcaagggtatcaaagaacactgctgcagtacttcctgttctacatagtcatgtgacttaagcaagagcatctgccagccagtgaggccccttgagagcctggttaaacatgggactgaagggttaagtgaatcactttttattcatgttgaaatatgaatgctgaagtttggaaaattttatatataacattttaataactaaaaaaacttgacttaggaatagtgcttatattaaaatcagtgtttgtcattgtttcatgaagtttttacaaatctaagaggcttaagagggatataatagtccactttgctttagttgtgttttacttgatattactgattgctttaactttgaaacacagaacaatgctatagtaagaatgtagtatactactctattaacccaaaacataatatagataggtttattgtatatttgtggagaaaagtttattctaacgttctttttacaaatagtaaaaatgctatttgtaggatgctctgatttttactttttgtaaaaagaacattgtctttttaccccaacagaaaatggcaagcgttcagctttctttgggaatccaaaatctcttatgaggcatattaggtatcacatgtgacataagcaaaagcctgtgatccttagcatgttggaaagttgctactctttaggataaggttgtccatgatgtctaggtcattccattcagctgcataaacaattcctttgatggatggctggttttctacaaccccagcattattttagcaggagaaggtagtatttgatgtgttgcaatttgtgttacatgcccatggaacatctctggacattacctcaggaggaggggttaagagaaggaggagctgtggctgaagacatttaatggcagaatgaatggaaattcaaagatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggtaatacccatattgattgtttctgataaaatactatggggtatagtttagcagtgaagcaaaggtgtcccttacaaggcaaatacagttttgaatgtagctctgaagtactaatgtattaatgtttcctttactgtggaacctactgacttagcaaatgctaatttttatcttatctgagtaacatgacagtaatttttacccaacataaagaatgatgacaattcttgtgaacatgtaaaatgtaagtacactgcttgaaaaagaaacatcttttctttcatagatagctttctgtgactagatactattgcttacagtttggatttaaaaaatggagctgcttatatgtgtgtgagccacattatggtacacagtgtgttaaggtctgttctataaatagggcttactgaaaagttctcttttgaaatatcatttaaacattttaaaaacataattagaaaatatgtgtttttgagatttgcaggtcatcatgtagacactgctttagctttttccttttccttctggctgtttttttgggcaggctaaacttattattttcattttgtagagtaatacatagaggcagatagcagctgataattctgtccctccacaggtatctataattgagagggcaagcccaggaaagaaacattaattgcccttcttcctgccccccagcattgaattatgaaattcctgtaggaacctctgctccttcctgcaactttatgaagacgttcattatcagagaagcctgaagttactccataggaactttgccaatgaaaataatctttagtgactataagtttaagtaattatattagctttagatatattgcttctttagcagcaaaagctgtaaaatttgaaatagaaaaaacaaaagaaaacctctgtctgttgatgtgaaaatgggaactcacagtttggagtgttctgcttatactttgcatgctcattgagttgactaagcttctattgtttcagttgctcaagtcaggattcagtggggttttggtcctgacacctgcaaggccaaggaatattcatagattcctgtggctgccagggatagggatgggaaaggaatgggagtaaaagaaaaggaagagagatggagacagggggaggggaaggggagaagtgtgagggatgggagggagagagagagagaaagagagagaaactagctcaagatcccaggagaaaagaggaaatacatatagtagccttagtggtgtgttaacaacttcagcctttaacattgagaagattctaacaagagtataggaaattaccattttaaattaagaaaaccagaaaggaaaatgtcttttatgttgttacatattccaatgtatccaattttactctttttaaatggacatcatgttttaaagatagttaaaatcattaggatgtagttacataatggccataaagggcactgggagcagtcactaaaggttagtggcattatgtctagttatatatattttcttgaatttagcttaattatagcaaaagaatgggaaaggagaatattctaaactaacatcaaagacattgtaactagatgtaaactatgagaatttattgttagtaatacctcaaggtactcatgtatcagttcagagaaaatcaatagtaatgaaagttatcccctatgattatatgtgccatctaatacttcaaagttgggtgacttggaatatcttcttctcactctgtgagaaggtaggtatgtaggtaaggataggtgcatcttcatcagaccccagaaaccgcgaaattgagtacttacttaaaatggcacagatatgattgaaattagaatccaattctccaagatcacaataagtgctccatacaaccaccaccacaatcacaaccacgacaaaatggtctaattatgtggatggattactgtgaaagcagttctagctcatggtgacagatctgtttcaagggtctgtcacagtgcacagctaagaatgacaaatttgtaggagcactaagccatcatttcatggtgtaaaagccattactcacactcaatcattactggccagagttttggaggaatgccaagcacaaaaaatagaagttcttgaacttcacaatagtgaattaaaattccatagaacagcccaaggggacttgtgttattattcagttattgtgaaatagtcctctatctacttttcttcctgccttcactttaaaaactcaactgtcttagaaaaatatatccaaatttactatttttagatggacatcatattttaaagatagttaaaatcattaggatgtagttacataatggtcagtgaagggcactgagaacagtcactttaaaggttagtagcattatgtccagttatagatggtaaatggattgggaaagacaccctgtagtcacatctataatcattgccctgtaaattgggttgctttttcgacatatttagaggtttgcttttcctctctctttgatgacagagacggtgggtttgacgacagcaatgacgcacttataattttatgtggcccttccctgggtatttgtcagcggctaatatttatagagtgctttgccaatcggcacagttgtattttacttacaggaaagaggaaagaatttcaaggtgctctatattttaaagaaagttgatatcaagggtataaatgatcaacaaccataaaatactaaatactaaaaagttttagataccataatctttttccattagtactgaaaatgttcagcactcattattacattcagcaggctgtaacagtgtaatagtgggatatactctggattgggcacaaaaagatctggaatctaacccctgttatgcatttcctaatgccctgttcttggacaagtcacatattctctgaacctaagttttgtcatctgtatagtgcaaatgatgactgatttacttgacaaattatgtgattgtcacacatgaacaattctcaaaaatctttaaagttttaaatttaaaccattaaactgaacattttaaagcaaaaactggatatttaaaaaaaaattccattctatacattttagtagaaggacttagtagagggttagatcaaagagtccttatgttttttatggactacaagttgttgcaatgacaaggtatttgataagaattctcaaatatttataataatgatttgttcacctttgccttaatattaaacatctctaagaagatatttcttataataaatcagactcaaggaaaatgaagcaaataatctttttttttcagtatggcaaatttaattccaaaaggcagaatagacaccataataacctatttcattcattcattcatttattctttaataaacacggaacctctaccatgggagtatacaggaagaatgataaatagaaataagtggatcataagagtatagtctctgatttcaagaaacttacagacttcagaattctgagttcacaagtctgggaaagtcatcaaagctaaatagttttatttttacttgcaaatgaatttggaaatcaaaagtattaaattgtaaagcttaagttccctatgaatagaaaagtgttcaataagtactccttctaacattaatccactcattttttaacaatggtgacctgtgttataattaagctaggaacctaacaatccaagtgtcctctctgatacttcagctacgaatgagcactggtagtcattatttcttttgaaaggcattcatttttaagattttatattctgattttcacatagaagtatctatttagttccgtcttgaggagctattgtcatttgattagaaattggcaactataaaaactcctacaattagaataatttacttacattgtagtagctttaaagatagtcacaggaaatataactcattatcatattggagcctctgtacacgttagatgtaagagtggggatggggttatcacacacttttaagaataactattttattggacttttactacatatagacacattttaggacggatttcatctatggcaaactacatttttgaaatattaattgtgttcagtcccaaatgagctgttgcagaattagtttgcctgatggacaactttacatacttttggcatgcaatacttctctaattgggagatggcctttcttttgaacattttaattttttccattttttatatccccaattttctaaaatatagattcatttattagtcaccaacaacgccttgacattatgagcttcttgacataaaactcttgaaaaaactatagtttaaatgtcctagactaggttaagtgagtgaggtacctgagatgcaaaatttaaggaggctgtcactgttagtgtcatggtgtatctctttgagagttaggccctaagcacatcactcagtaccctagtcccagctttgggtcagaagctaagcattctggctgtagaactgcccaagggactagtactaatcttgacctgtgctttcctctccctcattccaatttgctcatgtctagccagactttctgacgatctagaggtgacattaggtcttattgctatggaaatggagactattcctctgcctttacatctgtattagactttcttcatatttccaacctgttccaaaaattgaggggtgctgtagaaagttttcagtatctcttaggcaatgggcatgctagaattcacttcaagccttcaggaggagtttggtatgctacgctgactgcccttgatgggatttgtatttcctggggcatttgcaatgacggaggcccgaaaaaagctgcgcgggccaaggtcaaagtttgtgttaggctccttagccctagggatctttagcttccatttgattttcttcatgtgatctaaatgagttgaacttataaaaatattttcaaggctactctgtttgctttttatttttttcaacttgttaaatgctatacattgatcttttaaatttcatagggaggtaactgactaatttgaagttctcataaatgaatcaatagggttgctacattatgaaagaattttactaagtttcttctataatgcagactgaaatataagaccattttaatttatcaccaccatacagtaaaaattagcttatgatatgtaggttcctccaggattctgaacaacttgccacatagcagatgctcagtaaggcatattaataaacctacactttatgaacatactttgtaatgaaatttttataaatgctgtattttatttacaatgagaaaccttattagaataaaaatgattcataaatcttaatcttttgtttataaatgttcaaacataaaagtacttaagtaaattaaccttttgattttgtccccttaacattggcttatgtttaaccaaagaccgatgacttaatattaacttggaatgttgtaagattattaactgagaatgtggtaaggcctaattgattactgctgttacagtgcttcagaattttgaagtgttaggccttgtaactgcagagaagtctcatgaaatatttcaaagacaaattgtgctgaaattctaaatttcaaaaatccatatcttaatagtgtaattccaagaataaaagaataagatttcatttacttgattttaactttttaccatattatctacacaataattacctgaaataaattctggctttaggctttctacttttcagtgcttagttcagatttattttttaagaggatgagtactgaggcgaactaatagcttagaaacatcaggtaagccagaaagcacgtatgttatatagccttaggccttggtgaaaatggaaaaaaaacatgtggggcctctactttttctgaagtgcaaatagtttacgtagataaatgattcaacagcaataccataatcccagagtaaattattttcatttttactactagctcaagggaattactgacttttaaatggtgtttttttttttttttcaaaccttttatggaatctattgctgaattagcttaaggctttacaggcagaacattttagtggtggagtctcatatctaggagaagaaacatttctgttcctcccatttcacagatatgtaagtgctgaagttaaaacaaggacacatggatgcctgtttttgtacgtaaaacaaaatatacattagcaaatttggttagaattttaattaggcttcaaacaacagatggatctttttaatttgaagttttgttattgtacttatatacccgatgccatagttgtgtttaacctggcttcagaatgttctaagtcatttcttctgctgttattttattgcttactcaagggctcatttacatactgaatgttatggcaatacgacacaaatttgatttttccttttctttttttgagaataggttgtttaaatcaaagcataaggaaggattcttgctttatatggctgtcaacaattatataaataggacattttagggcaatgctgtttacagttgacgtatttcttccatttcaacctaaatattgtcatgtgtttgtaacaaaacatgctgtttttcagtttcaatgtgtttcttcctcttatagtcctgtaagctccacatatacaaaagcctaatgcaattttaggctgcaagaaaagtctcattttgacttgttttccatcttgatataaaagacccgaagaaaactggttcgaagtaaaggatcgatgtccttagaattagttcagaatgctgatgggttgtgaaacaatacatgagcaatgagtagatgatttttaataacataatactgaatgcaaaggagaacctaacaataatgataaacactaggctgcttcaaaaacttttatagattaaattacaaattatgtttgaattttgactgttacttcctaagactaagccctctcaatcagtttagcatagcaccagggacagatgctcaaacctttttcaaggggaatgtagctgtgtgactctcattaatagctgttgcattattctgattctggaaaacactttgaaacatctacccttttaaactgaatctcagactgagtattaaagggtaaaattgcagtcacttatttgtggtcccataaagtttatgaatcatcttactaagaaatgaaaatatatccataaatgtaggcttacaatgaattttaattgtgaggaaaatttaaaacccctaaaagagatgagatttttagagaaatttcagagcttgcagtattctatcttgtaacatcattagaacattgaaatattgtttgacaatggtgaaacaataatatcaacatccacggcagacaaaccaaaacaattgagagtttattggaatttctacttatatgtaaccccccctcacaaaaatgtattttcattaaaaattacttataacctgtgaaagaaatctcagactttacaaatattaagaattgcaacattaaatttagttaacaatgatttttttttttttgagatggagtctcgctctgtcgcccaggctggagtgcagtgctgcgatctcggctcactgcaaggtccgcctccggggttcacgccattctcctgcctcagcctcccgagtagctgggactacaggtgcctgccaccacgcctggctaatttttttgtatttttagtagagacggggtttcaccgtgttagccaggatggtctcgatctcctgaccttgtgatccgcccgcctcggcctcccaaagtgctgggattacaggcgtgagccaccgcgcccggcctagaatgctcattttaaaagtaatataggaatgggggccggacttggtggctcacacctgtaattccagcactttggaaagccaaagcaggcagatctcttgaggtcaggagtttgagaccagcatggccaacatggtgaaaccccatctctactaaaaatacaaaattagctgggtgtggtggcgcaaagtgcctgtaatctcagctactcgggaggctgaaacaggagaattgcttgaacctaggaggcagaggttgcagtgagccaagatcatgccactgcactccagcttggtcgacagagagatttcatctcaaaaaataaataaataaaaataaaaataaataaataaataaaaaataaaagtaatatgagaatggagatcatatagctatttttgtaattcagtttaatttagaaataggagtactaaataaaattataaagtaagattaaacatggagcaattacatatacataggaaaattccgttttagtccttctaaatattgtgtgtgaaaaaatctgcagtcttatgaatcttcctccaataaattttctaacaaaggaaacatttagtattactaggccgtagagactagtaatttaatctttaatttttaaatttatatgaagtaacaagagaacacaatttttcaccgcttattttataacctgattggctcccagattcacaatacgtgtaggctccagactaaaaaatgccaaactgttagtggaaagtaaccttaaggcatttttcttgatatccatattagctacaatccttggcctatttctttggagtatgtttacatgttttatgaatataattacataggtgggagaagaaaaacatacaaacataatttcaaaaagatggaaataatgttaataattgcagccacaatttaaacatattggttcaaaagtttaaacgtatttctttgttttatgagattcaaacaaaatctcataaaaacatgagatttttagaaagtacagaaaaatctctctctctgtatgaattttattttaggcagttgcatgctaaacttgtgcttggttgttcaaataaagtgaatgttcacatgtggactccactcttgaacatcaggcaacttggaagtaacattaactttggcataaggactttgactgatcatttggtttaagtgcctagcatgacttaggttctctgtaaacaaatgctgagatgatgtttggggagcatgctctctattagggatcagcatctgtgaagcttcaggaagtagaactggacagagaactaaactgtaatgcagttttgataaagccttggccaacgggataggaagctgctgcccaccagactttcctggatgtggcctgaacctttctatccaggcctaacttagacactggtcatggggtattccaagaaagtcatggggcaatgcagccctctacagctgagatagaccctgaaaaatttgacagcaggagatggtttgctgacctcactcctcacagcagggcagcaagtttttccattattaatatgaataattatctatgttatctagaaattgaatcctccatcactggggaaaagggaggggggactgagaggtggatctccttattcatcacagcatctagggttccaacaatcttcagtgcttgagaactcaagggcctaggatcagtgcaaattgttctcgaaacctgctgattctcctcagattataatgactcaggtaattcatgacttgacatttcactttgacaatttacagatttatagataggtagttcttggttgacctgggcctgttgtggcttatccatggcaattttgaattaaggctcttataaataaatttaaatagagttcatgcttaaatttcttttaatcctcacttacgaaattggaaagcagaaataaaagtaagcttagaaaaagaaaaagaggttataagtcaaacagactgggttcagaaaccgctgctcttccagttgctaatagaatgatctttacttctctgaggctcagttagttcaagtgtaaaatggagatttcaatattacctacatcattattttttgtgaagattagatgagaaaacccactaatggctttaaagatagtattcagtacgttcatgttaactgttattaaggatgtcatagggaattgatcagaatggagttctcggtgacacaacatgctcccaaaccttacttttccaacatagcttcataattctgtttgaagtaagatacctttcccagaacagtataaatttattattcaaatccaaattctcaacttatttgtacaactgcatatagactttaataaacatagataattatatatgcaacccagtttatgttttaataggttatcagtaaagtaatggcagaaggtagaaataggatagtgacaggtcaatctacgtctaccagacatgcttaagaagtgttaacgctttactttatccaaatatcagtattacagcttttttaagggaggtattttaacatttgaactcacactagtgtaagtttaaagtatacgttatctttaattactatttccaaaattaattataccaacatttactgaatgccaaagatgtaccaggattatacatagatctcaacaacaaaaaacagtaaaaatataatagcctcagtatttttaatagagggagaattattattagttataacatagttggggacttggtatagaaatgtaatattgtaagcatgagaccacatcagtgaattaaaacaaacaaattttttgctgacatacagtaaaatttggcaagcattttagatgaaaagtaaaggaagaaaaagagaatgtttgggttatatatactgaatgcagctttattcttttccctagtgatggaggattagatttctacataacataggtaattattaatattaatgatagaaacaattcatgaggaaacctaaagaatgacatttagaaatcacctttttgggtcttcttctgaaggcattacttatatgacacctgaatggtagaagaaagcctaagggtactttttgggcagcaattgccacccagccttaactcattccttactttcatcttctatcttttagcatgaactatacctatgtgaaatatttgtctttgctttcaagaggagaagatgaaaattagtaaaatgaccagaagtcagtgagcatcaaataactattttgaaaacaccatagtgtcagcattgtaacatgctaatatcacataatgaagtacatttctatgcattcaccaactgtgtagtgagaacattactgtgtggacaacagtgggctatttcagtggggatacagcatggaattaggcattgtgttttccagatgtaacattgagaagttaaaatctagtacggtagataaatacctttagcaattaaaaggtaacacacaacagtatacaccaaatgcagtcagtggaagcacaagaaaatcagtgattaattctgatttagtacacaccatgggtactaggaagcagtaccaggatgtaaaaggcaacgaggaagacatttatgcacaaaggactgacagagaggtggggaatctaaggtattccatatagagagcgagccagatgagaggactttgaatgtgaattgaggaatttggggaatggtgtcacccaattaatgtttaagaaagccttaactatatttcataggacaggtagaagtaaggagagactggaggcaggcagaacaagtaggaggcaatagcaggtgatgatgggatttttgtcttgggtggccatgcaatttcatatagtgtgaagttaattctaaaaaccaataggtaactatttattagttagagccattattattattagatactatgtgatgaggtagaactatttttaattggagtattatttaaataactagcctgtaggaccagatgtgacttgacagttgtgactccaagatacactaggaaaatatgacaaagggagagaggttgagactccaagaaacttaatatttaaggttttaaaatattcgtaagactaaccactgctagaaaaaacgttgcattagatatctacattttagataagttccaccaataataaaacaagtgaattaagaatttgaaacatggttaaaataaaaaattatatgcagtgtaagatgaaaaaattactgtttaatattttcagaattaaaagaaataatcaggaggatgggtgtggggtaggagagcatatgctttttttttctactataacttttcctctcttatcaaattcactatttaatcatttagaaacattctgctaaatactcagttgattatctgactaaagtaatttcactaaagtgtgaacaaagcttagtgacttgtctactctgtgctagccactggtataggctggaggtgcactagtgcaagaagcagacccaatactctgcctgcatgaagttcactttctaatgtgatgaaatagataataaaaaaatcactagatggtatgttaaaaggtaatgagtattatgaagaaagagcagaccaaggagaaagagggctggggaacatactgtaattttaaatgaggccatcaaggcagacctctccgagaaaatgacatctaagccaagaggaaggaatctttaaattttggatttttaatacaaaatttggcaagtttttttattgaaattttaatttttattgcttaaaacatcagtggaaaagaaagggcaaattctttggttaaagcttaatctctcaagggaaaaatatttatctttgtatttccacgtatttcagtgacgcctcagtgatatccttattgaagttttctctgttttgtaatccattcccttatctagccttttactaaacgagaagactggagacattcatccatttatctacagagcctagcaaggtgcttgacacctggtaggagttcagtgtctgagacttgaatgtctaaatggtcttattggcatatacatttttattaaacacatagggatcatgtcatgataaggtcctttattttatagaactcacatttatataatcctttggttacttttcctgacattctacaagaatacactcttcttttcattaagatttcctttgtacttccccttttcaaagtaagacgtgctctggcagtaggcacttaaattatacttaaatgttataatctaattcctagcctgtggacctctgtcaacgaggactgaggatactaaaatatcttatgatagtaacaaggtgatttcttttatactccttggaatgaaatagcatttggggaactgttagttagaagaaaggattccaaataatagctctttgttcagtgtttgtccatcaattcatagataagtcaattggcactcatcattttaaatgcatcaggggccagtgtagttaggagatatatagagagtactttaggcagtaaacagaggctttgtaacaatataatgtgtagtgggaaagaggattggaagatctataaaaactgccaaaagaaccaaaaatataattaaagcagcaaaaagacatattgaacacaatctcagggactatttcacgcaatagcaaatgtctcttcaactacagagatggaaagcaaaatagaaaactagtttcatgaagggagtgagaaaaataccaaacagaattgtaggaataggctcacaagtgttgattttcttatgctaatttttacccttctttaaaatgatcagaaagtgtctaacccagatatgggataatttgaaattctcagatgagaaaagagaaaagcaaaataaaaatataaacaaaggtaatattttaagcaagcatgtctcagagtagcacagataaactgatatgtagaaaactattgaaatttacagtctacactcaaattttgccaactaaatacagttggtttaggttctatcaaagttacatattatctaaatttttttctttttcttttcattttgtaaaagcatggaggtttacacacgatttcctcaagaacaaaaaaaacaatatttccagtagaaaatatttttcgatggcaaattttcattacttagacgagaggtttcacctaataaaacacatcagagttacctggggagttttcctaataaacacacttctattcagacccattagcagagatatttgcatagcttataataatctttagaaatacactgaatactatcactcttactttctaaaatcttcaacttctgtcttgaattgtaattagacaaaaactagcaaattaaaacaaaatttagaatcagaatagcacattatcagaagaaacatgcgaagctgatttcctggatacagaagcagaattcagacttctgtattaagatcatttcttccatagaagtctggtttcactcataataaataataaataaataaattattgtggtttcctttgtgctgagtaactctaaagtatttttaaatttagtgaagacaaactccaactatttaaagtgtcaagcttgagatttcaaacactgggtcgaaggaaatagataaatctttaactcaaagataatttgataagcctagtaaaggacaaaatatttttggctaatcttgcccaggaacacacgcatatgctcactcacacacatacaaacacacataaaatgtacagtagagtacattgttcaatctttctcagaaatacaaacttgaaattcacatatcgtacctctgatttaaaaaaactaataaaattatctgttgagaggaacatcttaaacatatcctatcaattttaatggaaaacactaacatagttttgtgtgtaaatgtaagttaataggtatacacactcacacataaacaagacgtcggaatatagtatattggtttaaaggtaatcaagacattattttacattgcagaacacaatcattctaatgacaagagacttgggtgctttggatctaaaagaggcatcttatttctacagagagaattattatagaaaaataacgggctttcttcattttaacatttgaaaaattgagtgcatgttataaagcaagaggaacatagaaacaaaggtctagaaatcatttatggagttcctgctgcctactaaagtttgtgtgtgtgtgtgtgtgtgtgtgtgtgtgtgtgtgtgtgtgtgtgtgtgtgtgtatgtgtaatgggagtggaggtggggtggcaagatttaaaaggattaggcactttggcctcagtcctaaaactgtaagggaagtaaaatgaagaattagtatttttttttgtcttcgatgactacacttaaaccttgcagaaagaatagcacaatgaactcctttacttcaggaaattcgactcatggccagacttcttttctctatatgcctgtctatccccctgactgctgattactttgaaggaaatctcagatatcatactattttatccttgaatattacagtgtatatcttttaaaaggcaacaacttaaaaatgtaactacaatcctaagaagatcaatcttaaaaaattacttagtataatcaaatatcaatttatgattctaatttcctcaattattgcagatatgtttttctttatactttaatttttaaaaaccacattctaattagtttgtcctatagagtttcttagagaatctgtattttgtctcctaaggtgtagttgaaaacatttctctctcccttgaattttacggaaattgagagttagatttaaatggtttcaacaacagaatttagagtatttataaggagtagatgatgtctgcttcttaaatgtttttccagttgtccctcttcttagctaagaatttggtagacactggctcaaagattattatggcaaagttatcaaattccgaatgccatagtatagagaaggaagtagacatggatataattaactctaataaaaaagcaaaatacaatatacttctagaatgttccacagtgcttggttttgtgtcagcattaagagagtgataaagtttcagtttcttcatgaacataattctggcatggaaagggcaacccttgggacaactccatcaaacacaagagctctgtggaacacagtttgatagataatcttgaagattccttctggctctaaatctcagagtgatgatgagctgtatggtacaattcacaatgtttttgcaaactcatgaactttccttaaagctattcttgagcaaagctagggaatgataaaggggaaaagacagatacataacatttcagctaaagtgaagtatttctggcttgttaacaactctacaagtaaacttagaatagacaatgtatctgcatgcttcagttcctcttccaagaaaacaaaacaaaacatctgccagttacaagagctatatatttgaagaaaagtgacaagtaataggaaagcaactggaaatctgggcattatggtttcattaaatatactgtgcctttatttaatatgtctgtgtattttacctttggaatatttttgtgtgttttgtattatgtattctgctaagattcatgcaactgtttcttcaggcacagacagcacacattgtcctggaagatggaactaagatgaaaggttactcctttggccatccatcctctgttgctggtgaagtggtttttaatactggcctgggagggtgagtaatgcttttccaaggctttatttttcctctagtagagaaataactggaagatctcactcatggtggtaagttgaaatcactgcatcgtagtaagactacgtattgtcctgaagttgcaccatgccttgtgcatagcctactgctgccgtccttgaaagaaagttagacatgaacttcctgctactgtaaatgaaagacaacatgggcacactggtggtcccctggataaaaagaacaaaatgaattctagaaacttaggttgtgaggacacaggttatgtgagattaccaaatggtttctgtaaggggaggtatgggtctgattaaggtgaaaatcggagcaaggaaaagaatagatagtatattctagtgctatttcattaggaaagaatcaattttgcacatctaatatgaaatactataagaagattagaaagtccttgggtattttatataattttgcactctagtaagaaagttgaaataacagatacatttattatctttaatcaatgagggagcatctgtgtagatctaatattttcaataattatcaactgtgacctgccttagtatttaagacctgctaacatgtacagcaatgaaaacgagagttgctacagaaattaagtggctgcttttacctagttaataaatgtttgttcacctgggaatcaggaggctgaagttctagtctcaattctaaggataactaattatataatattgggaacatcacttaagctttttgagttctagtttcttcatataaaaagtgagggggttggattaaatactaatttacagctggggatttaaacaattatgtgtcttaaaaacatgactagattgattgaaggggtttccaatacagattcaatccaactagtattctatgaaatatttgataaattctttagagaaattcaagttagtctcataaagacaagggggcattaggttcactgatactgaatatactaattgaccaaacttccattatattattaatttatattctttcttaaactcttgcctccctgtgtgaaatgaagaatattagaggggtttttaaatagttccactggtgagaacattaaattacagtgtatgaaatctgtttgcaaagttttgcttcaccaggcaattatttaaacttttcgacagcactaattactagctgtgttaatatacctgccaacaaacaactgtttaatatagatcagcatgatggagggcactagagttttcttctctgtgatagtttacaggtaataaatcttgtcacatcacaaaagtcaaacaggagctgatggattaatttgctcccaacactgtagttctctaaaacaaagtatatttattcatttactgaagagtattgtaagcatatgtttaaagggaatggtaagttcttttatggaaagaaagaagaaagagaagtaaaatcaaattaattaaagtttttttttgatgtaggaaaaggtattcatctataagattagtccatagaccctattttccattgagaaatgcttctttcattcattacgtgcctcactcagtaaggtggttgataattaaaggggttattttgtttttcatctttaagcaatgcatttatattgtgggcaagccttggttaaaaaattatcagttcctgacagataagagacatctgagaaattagctgatggaagctgcggaaaaacaccacagccctcgagtcaccttagggattgcagagctgaaagactatgtattttgttgacaaggttagttctggtaggcgttagtctggatggtgttgaagaatttatgttgactactgcctgcgttaaactttattggtttcaaagtcgttgattctgtgcccctgagcacctaaattcactttcagttgtaatccacaaaaaaggatttagcttaactcattttgcagaaagtggacatggaagagagcaggaaaaaaacctcaattgcagtgtattccagtgcatggaaaaagtgtagatagctcctggtattcatgggaataacgtttcttcttcttaagaataagaaatatgtgtgtgtgtgtatatacacacacgatatgtatatgcacacacacacacacacacacacacacgatatatttgtatttttcctctcacccaaacttaaaaatatagccctcctgcattcctccctaattccatatcagtactttaaaatagttagttggcatcttttaacttagaagtcagaaatccctcaagtcaagtctgcgagatgaatttttttctaagcagataataactttcaaacttatatgcttctttctaaaattaaaatattttaaaaatcaactttattgagttattctttcatataaattaactcacttattctaaatattcattgaattttaataatcatatatactcatgcaaccaccactaacacaatcaggctactcttcagtatcctaaaaaatatcaagaaaaacttttcaatgtttcgatggttactatcttggtgaaactggcagccctcaacagtaaatatcagtttgggctcaatgatatctggtaggccagggaaatctttagagtatctgcaaactttaaatagagcagggatattttaaaaattaagatgctagcaagggatttttaaaggaattaaaaaatttaaagaaattgagggaataaaacttatatgaaaatataccttggtactcacgagttggtttttctttatatcaatgacatcgtggtataaatttttatattctgtcataacatttccccaggtacgttaaaatctagagacattcttgttggattcttctcattttcaagggttaaataattcagagcatgtatgcagattatagctttgtagttacatacattatttgctgataattttttggcatgtttacccaggtacccagaagctattactgaccctgcctacaaaggacagattctcacaatggccaaccctattattgggaatggtggagctcctgatactactgctctggatgaactgggacttagcaaatatttggagtctaatggaatcaaggtagtaccagtggtggccatttaaaaagtctcaatttgagggagtatagttgacttattcttaagaattaggatggccaaactttcttcctcaatacggtagtacaaatcattaagctcatgtattcaatcttattcctaggtacatgagaataatctttaacttgacagtattttgagtttcatttctcagggcactttgaattttaatgcgttggatgaaacttggcttaacttgaaaaaaatgttataagttcaaataacaactatgctataaaaggattggggaagaatcaccttttaaaaggaatttggtaatgaattctgtatcaattatttgctttttaatcttagcctctaggggatgatttaaagatagcttttatgccagtctaaaagtaaacatattaagatttcctaaacaaggtaattttggatactctcttaggaatatatatcatataaacaattcaaaaatttatattccaaattcaatactattttttcaccattccatttttgaatgacttcaactgatcatttaacttagttttcactatttctcacaatttcccatcaattttttctctgctttaagtataaattaaaaatgattttgttcatcatgtgcattaagccagtaattattaattaaattcttgataaatgccatgcatgtcagaagggggacctagtttagtctcaggatttaccaagccaggtaagcctgctccctctcaggataattaatgcaacaattacatattttaaaagaagggcattgatttttttttttttgcctcttgtttttaaaaatcctaagtctcatgtcagtggatatcataaaacttaaaaacaaatgcaaattgactcacaagagttggataatatcttgtgataacctctttaaaatgactgtctgtctttctaggtttcaggtttgctggtgctggattatagtaaagactacaaccactggctggctaccaagagtttagggcaatggctacaggaagaaaaggtaagaaatgtaatagggcatccatcatcacctaaggaaggttgagaaggtgcctgtagattcagaagtgccaagcagacagaggaagatcatgtagtttgggatctttgcatttcagagagggattccttctcttactacataaaggctgaaatgtctgaattcctccttaaatgctgatgagcacatattttcagtttatccactaggtggcactcatacatgcttggtagcacttcacatttgggaagggaggggtaagataaaattttagcattttctcttctctttagcaattgagtcttttactctccttcaccgttttatctagaatgtagtaatggaacttgcttcatgggttctagtgttctagtaccagctctactgttaactggttgtgtaactttgtgcaggtcacataatcattctatgcaatacttgcatcatctctcattcttatgagtataagcagattaccatcaagtctcgttgggcttcaacattatgacatgtaattatatataatttcatttgacatattaataatgtaagaaaagggttataaaactttatcttacacttttagtttaaatattaatttcttttcttttttttgagatggactttcactcttgttgcccaggctggagtgcaatggggcaatctcagctcactgcaacctccacctccagggttcaagctattcacctgcttcagcctccccagtagctgggagtacaggagcctgccaccatgcccggctaattttttgtatttttagtagagacggggtttcaccatgttggccaggctggtctcaaactcctgacttcatgtgatccacccgactcagcctcccaaagtgctgggattacaggctcacatgagccaccgcgcccagccataaatattaatttccaatgaaaaaagagcatttgccttgtttggatgttagaagtacttaagttaatggacctgcttcaattaacttcatctccagtgttgctgtagctgctttttgttcaactgctgggcctgtaattgacagaattttattctacgaaagtgctgcctctccaatgagtgtctatctatgggggctaaacattgctgctttctgaaaaataaaaaaaatcttgatcctggctctttagatctcattctttctaaattttaaaagggagaagaaggcatccatatcatatcctgggccatagccattttcttctcaactattatctgaatttatcttccttatccaggcagctaatttctgtaatcgtcatttgggagacacttctctccccccagcccccaacaacccaagctttccttttcctttttgttatttaggacacttgttctcatagcttttctatgtcagaactaatagttttagtgtaagcctaaccaacggcttgtaagttcgttttttaaatgtgctttgaaccttcttccatgatcacagacatgtagagtagaaaagaatccaagataataaccagttcacctccttcaatttaccggtgagaacaaatacattgcttaaacatttctcagataattagtggaagaaaaaaaaactagaacatgttttcattttttaacctctttttaaaaaaatcttattttagtaaaaagcctcccgtgggatagaacctgttttcttgattcctaactcattactctttcattataccacatgtgtctctatccaacgtagtcaaagaaccttaaaacaaatggtggtcctgcctgatggactaacaggatgatcatgttttagtacaacatgactactcaacatggcccttcagaaaaatgtgttgagtgcctactctgtgccaggaacatttggctcaaaacatggatttgcatattattgcttatgaagttcaccaatgtgatttaacttacttaacatcctgggttaaaagcaatagaagtgtagcagaagattgatgttcagaatttctcatttttttactctgagaaagaacctgggtattaagagtcctatgcctaactgtagcaacaatttactgtgttctgacaatacagtcaccctgggtcagagaaaagaaagagtggagaaattatttactgctcaagaagatagatgaggccaagtttgtaacttgaaaacaatatgctggatttaatctcctccaatttcactgtcactacaatttttttcttataggttcctgcaatttatggagtggacacaagaatgctgactaaaataattcgggataaggtataatcatcatctttagccaaatctatgtttcttcgggtgtgtgtgtgtgtgtgtgtgtgtggtgtttccctcagtgcctaagggatccattaatatgtaaaggagtgaatctggccagcttctgctatctgggtctctgttattttgttttactattttcactgtaattttcaagattgaatacttgattggtatgtttttaactgaatggacttgagattcattcacctggcagcttattgagtgcccactatgtgttcattataccaacaagtcaaggaatttataattcagctcatgtgatagaactttagtgaaacaagtggagaaggtaacaaattgcataacaattttgcctgaagtgaaaacctacatgctgaaaaatacactccaggaagtgtacagcattgttactgttatttgttttgtccttgtgaaagagttatttgtaaaattaatgcattatctttcatgaatgtgccaaataagccttgcatgcattacttcaattatatagtctttgttgagaccatatcaataaccaaggtgataaaagggaaggttatcttttgctttcagtgaagtctgattgctacaacatctgacccctcctctgagaatatctcatcaccatctgcttgttgagtttattattattttacttgaaatttccatattccaaatctgaaagaaacattacgtcactaacgttaactaaattccccaaatgcaactaaagttttcttactaaatataattacataaaaataaaaagataaatgacacaatttgaaactacacatgtgggctgggtgcagtgggtcatgcctgtaatcccagcactttgggaggctgaggcaaacggatcacttgaggtcaggagttcgagaccagcctagccaacatggtgaaacccatctctactaaatatacaaaaactagccagttatagtggtgcacacctgtaatcccagctacttaggaggctgaggcagaagaatcacttgaacccgggaggcggaggttgcagtgagctgagatcatgccactgcactccaacctgggcgactacaggaccctgtctcaaaaaaaaaaaaaaaaagtacatatgggaaaaggagtcttcaaaaaatttttttgtagatttcttgttaggatatatacatatatatattgacacaggctttctgtaaacagaaggaaaaaacagctttgaaaataaaaacatggccaaatacccatgaccagaaggaagacagtgagagtttatgccatcattctatcccacctctgattttattcactctaccacgattttcctgagaataggtgttagtgaaattatatatcccagggagattcttgtgttctctcagcctaatgatgtgtgtgagcagtaagcaatgacgaggctatgagggcgggaaaggaatacagttgggaaaatcaattcagatggcagaattggcaggttgaataaaatatagtcaggcctaatgattcaggaaaactttacaagaccgcacttgtctttcatgtgatatgttaggttaaaacgagccctccttttatcataggcagttaggttttcaaaattggcggaatagattggcacagacaaaacagtattgcctcatatttctttatcagtgatggtggttcatattaaaaatgtatattatggctttcacttctattaaccttaatttgaaaagtaagatcgtatttcattcagcatgttttaagaaaaggggaaggagaactaaaaaccaattttcaaaattagggatccataaatatagacaaggggttatgcgacttggattataaaagtaaatacaggccaccatgaaatgtagtaatctactatggaagtgaaaggtggtttttaggtagtgttcccagacttagaggcagcactctgaatttaataacagcactgaaacatccatcatgcttgcatgacacataggtactttctactctcacttacccccaagtgacttctccttcaaggaatacatttaaaagggaaatgaaagcttccttctatttccttccatgcaataatttcatcagagaagggcatatcaatgaattattttgaatttttacccctcaatagaatcttgattactaaatatagcatgccatttttctaagtagttcaaagcagacttactaacaaataagtaaatctcaagatacagctgaaaaaaggtgacattgtcgtgttcaagctagcaaggatagtttgtgaaaactttacagagggttgaacattctttcaattcaggcccataggaacacttggatatgaacatgcctaaacagtgaatattttcatttcaaattctagaagtttatgacttatgttgcatttcatcttctttgtgaattaatattactatcataatgaatgaattcccgctttttttgtgatttttagattccttattgtctcaatagattttttttgtccatttctctcatgaaatgtctttaggtcatatacgctgagtagtgtaagtttactaaatatcccgatttgcatcagcctggagcctggagacctgaattctgatgccttttgactttgccttcatcaggcaatggtgtcagccctagaagaactaattgtatttccaagagtatttcccaaaatgtatgtgcaaattgcttaatcttttcagtttgagaagatgaagatcttccatgatggttacgagtagttataaagacatctaagtcttgcagcagctgtttaaagtccctgtgagtttatcttgtcaacacctttatcgttgcttccttttaactgtctaatttttttaatttgatagggtaccatgcttgggaagattgaatttgaaggtcagcctgtggattttgtggatccaaataaacagaatttgattgctgaggtttcaaccaaggtgaggggttttcctttatattttgtagttttatttgatcccatttagaccttcttgaaatatcaaaatctttatttaggcagagtttatcttccagaagcaccagtgttcaggggtagaaagggatctcatagcagctaaaatacaccttacaaaatcagtgcatttaaagctggttttacttacaggcttacatgggaaacttcatgccccaatttagaggatttttactaaatttagtgttccttccaccttttctgattcttcagcttaggattttaacaatgtaaaataaaggaagcactgaattgccaaagataggtccagtgatgatgaggagtcagagctagtaacctgccagagagccaagagaattttacagaaatcaggcacagtaatcagaatctgggggcattttgtgcaggaaaaatatttattcatacactaaagatttattgtgttatagctttgtttcaaaattaatgttcgtaacgatgactgagtcaccctaaagtgaaatatctttagtatacatttataaaaaggtaaagaatacattttagaaagaagtccattggttttgattgaatatctactaatgtaggtgtgagtgagtttcttgagctacagtctctgtccttggggagcatagagcctggtggaacaaacaagcaagtaaatcaccatgtgcagaatcctgtgataaatgctgtccttggagtgttcatagcatgctgcaagggcatgcatggggcagcattgaaatgggataggtggatcagagaaggccctgtagaaatgtgagtcctgttttgagacacaaagagcgggtagtaacagtaaggtagatgaagaaccaggagaactttgtttcaggcagaaggaatggcttgccaagaggcatagaggtacagaacaacatagtatatttgaagagttacgcacagtttgggatggctgaaccaaggggttcacacctattggtttacacacttgggcaaggataagtggagatggactgactgaagctaggtctagaaggtttcatatcattggctaatcagcacttccagaaactattgtcaactcatttggtgtcattttggagcaaagtaaagctgaataaaagagcaagcaactagaaggttattgtaacttatcagaacaaaactcacgagagcctgaactgagcagtagtagcaagaacagatacggcaacctaggccgcttatacaaatgggaggaagaggggctgaatgaggtcaggtaaaagatcaccttactttctcagctaaggatttcaactagttaggttgagcatagtgattatgtcatttgatatctgagatgtttatgggatactgctatgaaatttttttaaagaaaagtttttgatccgctttgaaacttaaaggaagaattgctaccttctgtttttactacatacaatgggagttaaaaatagagcttctctttcctaggactatgtatttggttaccatggggctttacatgtggagaatttagccctgtggaagcctatgtggcatcacagctattggctggttctaccttggggtttatttatactatagcagagatggctacaaacttctcttccatcaccagtgtggcaatggaatttctcagagaaactctactttatccaagtagaaagtgagtgttattttgacaaaggcgattgaaattcttagaaaggaaggagtagaaaatgtacatgtggacgcaaaatttgattttaaatagatgtattcaccacaacattttatttctagatataacatacacttttttgcccatgatatttcataattatcgtggtccattcaatgtggcagctctggtcttcaaggaaaataataacaaccaagcttttttgaacactcagttaattttcataaaaactccatgtcatagatgaagaaactgaggcttagcaagtaagtctatttaaaatcaaatgtaacttgcccaagtttagtgtcaatttgaattcaagtgactccagagtctctgtggctaacctcatgctatttttctttccattttgatgggagtttgacggaaaagctttaaaaagctcaatttctagatttatgttccatgaattcaagaaacctcttcaagactccctgtgaaccaattttctatttggcctgcttcttacaaggcctgaatatgtttgtttgcttctctacgtagaaatcttttcccatgctttctccttccccttctcgcctgaagaagtcagtttcaagagtcagctcattgttcctttgtgaagcttccatgactcatctcacctttggatcccatgtcatttaataaatagcttcagtataacaaggatcaaattgcatttaactctttgaaaggattgtctctttcacttgtcttggttggctctttgaggggagaggccatggtttacttatttgaatccccagcactgcctatagtacctttcacatagtacatggtcaacaaataatgaataaataaaggaatatacaaagccagtaaatggtagttacagttggtggtaaagaaattgcacattcttattttcccttcaaatcctttaatcagtgtttcttatggttctatgacctccattattaatataataaaattatcattattactaataactgtaagtcttattaataaaaaataggcacgatctattgagtacttattatctgctaggtttcttctcaatgctttacactgattaatttattccatcttcagtgtaattatatgagatgggtattattaggaactcatttactgatgaagaaactagggtgtagagagattaaataccttcttcagtgtgaatggccataggattatacataggaaggcttggtctagtgtctgtctctcagaaaacatcatcccatactgcctttcaacatagtagaaataatagttatgcaactaacagttatactattagtaaccatccttatactaccatgtgataatattcaaataagtttacattgtttcactccttataccttttacatatgcagagtaaggattcaagaattttaaatcagaaatggtaaaatatgtgaatatgtgaatagactggaaactgactctgcttgtatgggtatcctacccgctcctgtgacaaaaccttgtcattgagagtctttagaaaggatgttcccatgcccttcctgacacctgttcatctgggaaatgattcatgttgtgatacagcaccaatcagaaggcgtatagaggacatttcataaggaagagttccagcgtgagagtttttaaaggctttaaaaaaagttattaaaagagtaaaacagtctgatcagtaacatgtaagactcagagaaaacacacattgatattatctggtattccggctcctgtcacgtgaaaatgagagacaaggattttgggttcctagaaattagtactgagtcgtgatgttcatgtcgggcagggatgtgcattcaaaacatgctgaagcctaagaagtatgtgttgttaaagaaaatcaattttaaattagatatgtaattacttatatgtatggaatttgatcatggtgtttgcaatactcacttctgatttttaattttaaaattggtcccattcatatgacttccccttgttttacatatttccctgtgaaatgatttagtttgaaacacagcatgatagagggtgatgatagatgatagaatgttagaattgagaactgccttggtggtttagtctagcatttcctaaactggaaaacagtggtgtggagcaattcatcttaaaaaattctgtggtcaagcaaggttgcaaaatgctgcataagatattcctctctgttaagtccaagcacaaatccatatatgcaagtatccatgaggtcttgtgtaacttctgttattcttatggacagtatttaatgtgtttgtgtagagaccagcaaaaatgagcatatctgtgtttttatctgtgtccaatcaagggagatgctgcagtggtgaaagctggctcctttgtttcttaatgtcagtgcaattaaataatattactatagctatgataaaatgcgtatttgtatcaggagattacatatattttgtgagttttgtttgactacatgccttggaaatgttgataacttcattcattatcttgtaattacaattttctgtagctacaactagatggtaatattgctttattttacatcagaagcctaaggttaagaaaagatctatactttttcaaattatttgatgagaaagattacctgtgacattcaattcagcaataactccccccagatcttgaaaggattagggtatttttttttccttcagaatagtcagtgggagaaaaaaaaccccagatatagtttatatattttttcctcaactacagtctaaggattataatttcacattctatacagacttagtggagaggtagatatttcagtcaaaataaactgttctttcaaatactcagtttgtacttttcatctgaaaattttcacaaacgatgaaatcatcctaaattcatagcgtgctagctaactctcaaagcaggaaccggtgtgtgtgcccacccttctaggctttctctctattatttctccttttatgactttggggagctgcttcttgggttaatgcctgtgaaaatagatctgcctcccagccgtgcttcagacatagataatgattatgatatgctctgggatctttttatgaaatctaccatttaaatgcaaacaattgcacggcaacctaaagggactggtggtctatacctgcttagcaattcctgtgactcttatactgattttatccattaggcccaactgcagaagccttatgtacagtaattcagctttaccccatttgatctttactgcaagttgaggatcaagtggtatttaaagcatgatgtatctattgccacatctgtctagtgctgaatcaggcaataatgcttaaacatttcattgctaccagttgttaatgaggcaaaacatgagaaagatggttaactatgcatgcaaccagtttcttagagatcattgttattactataatcaaccgtttatataaaacagcaaagtctttttttctcataaaaaagatacagtctgtggcacttgttgtgcctttcttacaaactgtttgttaactgccagtcactccctagtagttaacaatcaatctgttaccaatctaagttcaaaacattgtcagatgtgtttatgattttggtctgttgcccatagctgggacttccctctcattctctggtttttaaaatggcaggatgtcaaagtgtacggcaaaggaaaccccacaaaagtggtagctgtagactgtgggattaaaaacaatgtaatccgcctgctagtaaaggtaagtaatttgttcatttcaaaggtgagggtttgtcatattgaccattagtgttcagctaatttcctctgtcacagagaaacttatgcattctttcagaatgtcaggggtctacattcttcttgttgcttttgatttacaaaataacacatttatccctgttcaaattaaaaatatagactgctatgttttttctttaaaaaaaaaacctcaagggccactaaaacatggaagaaaatgatgactgttcttgtcattaattgactgacagtctgagatgcatcatgttcactttctttgtggtatagagatgaccaaaaagctagagtctgtctgatagcatctcctttgggcttacatttattttgtaccacacgtttgtaggaatcatgccctgacagagtacgaactttcacattgtttttatatcaactcttagacaaccagttaaaattaaaccttaaaaattctcaaggagaacttaaccatcataataatgtttcttaaataaagttttgttaggatttttccttctcctcactcctctctcagtctgtctctgtctacacatctcccctccatacacatacacacacatacacacatatttgcataacaccaaattagcatgcgtattgggagactcttcatcgtacctccttattagagaataccagcaatattcaaatcatgatttcaaattcttgtcaattttattaacaaacatttgcatggatagcatgcatggtagcagatgctgtggatggcctgtgtatatctcaatctcaagttaccattttaattcatgttgcccatcttccaattgcaaatatctatatctctttgcctgatggctggagcctactggcaggcagtaaatggcatagaattaatgatctctggagtagcccccaaccaaagcacagaaaaagccagtgtttaaccaccctggctcctttgtcccatggataggcagtctctaaggtaactattccacacgggctctcagagttccctactgggcttaaacttcacttatccctagtggtaactacttgctaatgcataatttattggggtgtttcatgatgtcacttcctctctgtttagtatggaagtaccttccaaataagcttttgttctcttaaatccttgtttcaggaaatgcttcatgggaaaccctcaaagacaccttcctatgtgcttttatattaaaagaaatttctaagttttccattcgaatataaatcttacagaaaatgagaaaaccctaggaaagaaggctgattaaaatttgataagactaaaaggcaagactgaaaaaggtctgacgtgggccaacttaacattttcagaaaatggatttatatctttttgcaactggtcgtgtgaaggtaacctactctcctgtcagtccagtcatggcatttgtaggcactgaaacttctcttgagtgcaggagagtgcattatccattttttcaggatcaaaacttttaatggtgtttatttttatttttatttttattttgagacagggtcttactttgttgtccagcctagagtgcaatggtgtgatcttggctcgctggaacctgtgactcctggactcgggtgatcctcccacctcagttttctgggtagctgggaccatacctggctaatttttgttttatcttttttggtagagatagggttttgccctgtttcccaggctagtcttgacttcctgggctcaagcaattcccccctatcttgagcttccctatgtgctaggatcaccggcatgagccaccaagcccggccccaaagaaatttttgctcagcattatttattttaaatgtttacaaatttttccttccctttaaggaatggttagtcaagagaaagtctagcaaaattatactttggcaaagaaacatgttattaaattcatcattcttgtgtctcttttccagcgaggagctgaagtgcacttagttccctggaaccatgatttcaccaagatggagtatgatgggattttgatcgcgggaggaccggggaacccagctcttgcagaaccactaattcagaatgtcagaaaggtgcaatgaaccttgaattcatgtgtatctgtgtgggaggtgggggcttccgctctataccctcaaagggctgtgatacattttatttattcaggcatttttcaatgctggtatttgtgacttctgaggcagtgtcagtagagatattctgtaggggaaccaatgaggagagaatatcagagaaaatagggtttttcttcaggcaaagtaacttggggatcatgtccttgagttaaaagaactggagtccaatggccaaatgtattttgctttacagttttaaaccgacaactcatggttccttatcatgaccttgggacccataagacctgcaggtctctaaagaaatattaaattagatttagtttagtttgaatgtaaagtacatcttaatgaattataatgctacaaatttgtcaattatgtccttttttatattcttctttaattcagttactattctctttaccttcttaagaaaaaaggatacctcatttttgttcattcagaagcaacattttttggaactgtactaattggttaataaaaattctccctgatttagattttggagagtgatcgcaaggagccattgtttggaatcagtacaggaaacttaataacaggattggctgctggtgccaaaacctacaagatgtccatggccaacaggtgaggtattttcacttttgcttacagtaaaccagctctgacatactaactaaatacaaagaactcagagcacttacctgccatttctttagagtaaataaatgcacatgtaccctaaaacttaaagtataataaaaataaataaataaataaataaataaataaaataaaaaataaaataaataaccataccttacgtggttgacagttgtttgactacctgataccacttttgttgcatttttggaaagcagccttctctaatgataaccttgctataatttaaagttattttccttcccttggcataaattgaggttataatactcaatcaaatgatattccaagggaaattgttctgattttaagcttgatttcagaacattgtaacattttaagaaggtaagtgtgacttaagagccgaggaacctttagatcctcttggtttctcttttttgcctcaaacaatattaatttattaaacatcaggctttttcccatggcccaccctctacataaattataattcaggtctgagcagtcatctctttgttatctccctataactctcgggctttaaaattattgtagttctcttaaagtaagtcacttatatttcttagtttctgttaagccggtgagcaaccctttttgttatgagtgcaatgcccccctttctaaaaccgattatagaatttaatagacctgcgtatttaacacacaacaaagcttcctgaattgatttttgttgggaaaattactgggattaacaatctgtgacttttctcacagagtgattttcactaagcaattgaaattttgaattttaataggctttacttgttcactactttataaggaatacatttatattattctcttcacttttccttttccctattctttttctccttttctctccagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggtaaatgatgtcaataaacctgttcagttggtgatgagaaacgcagggcttttaaaaataattgatacataagcattgtatatatttatgagatacatgtgatattttgatacatgcatatcatatgtaatgatcaaatcacactaggataaccatcacctcattttttatttctttgtattgagaacatttcaaatcttctcttctagctgttttgaaatatgcaataaattattcactcagaatattcacccagagtttttaaatacactatgatgcaaatacctttctcctgtttgtttgtgatttttttggggttgagtgttgaaaaacagctataggttttctcccatagccctctgtgttttaaaacgtcatttctctctcttattctctcatcagttgacttgttaagattcactatttgagttattaatcaacaactatctcatatattcaatgttagtgggctgttggtccaaatctgtttgagccccatctgggtgggtctctgggacttacttggcactggtgtagtgtttgagaagacccttggaaaagtaatttcggacttggggataagatgaggacttgagtttactctgaacagaacccagaggggtcccaaagactatagaccaaattttttatttatttatttattttaaaggaaaacacattcagttgagtcttcattgacccattttccatacttaatcaaaaaggtcagatatgtaagtccttaagatatcggaccatgttacttaatagtactgttagttacaaaaattttgttaagcatctaactcagtttttaaatttgagctttattgttccctgaataatacatagccacacttgacattcattgttacagaaggaatttcttcctgtttcttattcctttaggggattatgcatgagagcaaacccttcttcgctgtgcagttccacccagaggtcaccccggggccaatagacactgaggtacgtcaaaaagatgaggcctattatgtatgcaaaaaaaaaatgtatttgtgtggaaattcgagaaaccaaaataatcaccccagatgatcttgagcagaacattctcaagaagagtgctttggtaacacacattttgtattaaaatctccccatgaatgtcacagaggaaatttttatcttttttaaaatttaaagtgggaaagcccttaagaaacccgaagcgatggtatttttatttaaacccattatcattctaatatatttagttctgaaatttacaattgttgtactatgcaaatgaattcccttttgctctctctcgttctcatgactgaaatgaaattttaatcccccatctgtgacttcacaaaaatccctatggcaactggttgtgtagccactaagggagaataaacagcagcaggagaaggaggggaagggtgttggaggggagagagggcatgcatgcacatacatagatgattcagacggcttcagaaaagaaccacaaggaatgcttagaggagttttgtatttaatctaaatatttttacttttttgtgtgtgagctcttagttcattgttcaaacccatctttccaaataaattcttctggtgatatccagaaaaatctgaagtctattgtgacttccccacacccaggggcctccagtagcaaatcttcattgtcagaactctcagaaaagacttcgaggtaaaatggggaagagaataagagctttctttctgcaagctctgctctactctctcatgtctgaattgccgttttagatatttatattttgttcttgttttaatattattaggaaatattggttcttaatagccaaaatcagtattatattaccaacccatgatgaaactcataaatcaaatttagttatgtgtatcatctaacacatgctaagtagttttttaatttaaaatttaaattagcatatattagtacttcggattaggaacattgcaattaagatgtaataatatccactgtcacataattctccttttttgtctttccaataattgcaaaatgaatattctttgttgtaatttgtcatatctagtgaaacaacagaagtaaatcctttggcaaagattaagaataatcttcagaaactgttttttagagccgatagaaatttaaatttaaattagtatttctaattttctatatcataagtgatatagcttcaattgttatatccacctagaatttgatttagaagaaacaaatgatatacaatttactaaaaacttggcattctcagaaggtatctgatatgtttactgcttgttggaaacttcttttttataagacttgaagtgaacagaagtgtttatttgattaaattctcacactaacagatatttagttattgacaaaaaagcaaaaaaagctgaaatgctataataaaaattatttgttgcttatctgaagttcaaatttaactgggtatattgtgttttatctggtgaacttaggaattttgaagcttctaactagttggttgtatttttttctagtacctgtttgattcctttttctcactgataaagaaaggaaaagctaccaccattacatcagtcttaccgaagccagcactagttgcatctcgggttgaggtcagtatgtgggcttatttttggtttatgaattttggattgtccctatcacatgaagatttttaaaaactaagtgatgtaaggcatactagtgtttaataaaagatgactggtaatattgtaatagactgtcattttgtaactaattatttggttccttcttgatgatgtctagtggaacttctcatgttttgatttaaaataatgtcttttaaagtttacttcttccagagtatttgtaataacataacaaagaatagtgtttagtttagaatttatttcccattatccaaaaagccatagctctatgtaaacatgagatacatttcagactacagaatcattatagatgatagaattctttttgtttcaactagaataactgttattcaacatcatgtactgagtattattttacctctaaaaagcaaatggacaagaatataacacttaaatccttaatttgaatatgtatgttagtgtgataaagtttttacccatttccttcataaactacacattcatatcattatttaaaatttagaaggatatatgtgtatttgaaaaaataccacacatagatatatttacatatatgtatatatttttggatatttatatatgtttaaataaaatgtaaacctctgccaaaaattttttacttaagagaaaaaccttaataaactttggaagtcacattgaaatcagagatgttttaagttattagtctttttccctatatattacatatttttcattacattagaccttagatgaccacataaactcagacaatgtggtttgtcttctccaatcttgaaaatgccttatttcccccattttagcagtaataacagtgtctttttcttattgcttataggtttccaaagtccttattctaggatcaggaggtctgtccattggtcaggctggagaatttgattactcaggatctcaagctgtaaaagccatgaaggtgagagaatatgatccttactagaattaatatgcttcctttaatgagtctaattagtattttataatttagatttatgacactacctcttttcaaagttgctataattattttccttaactgtgcctttataaatcttgtattaaagaagcttgatcacgagcaagaatttcaactttctgtaatgtgcacatctgtaaattgaggaggttaatctccaaaattatttaggttattgcctccttatagtgaaaacatataaagccacatttatttatgctgtttatttcttttgaggcagtgagtttttcaaatatacttatcttttatgtgaaagagaaattttgggcatctttggtgctttaaagtatttcaagtgctctacaggatgcttcgggcatctctgtggttgaaatgggaaactccagttggagaagcaagggcaacagtacattttgttcaggtgttataaattattatctgtcactgggggacacagttctcccatcagtgcctgggaaacgggatgatatggcaacattttcaagtagaaaaaaagatttgatacacaggtgtggaaggacatccttcctgtttctttaaactctctggagatctcccaacacttactgtagtaaaataaaactttagaaaaattccgttgtatatttaatgtatttctcttgaggagttcagttggtacccctcgttgtgctaatcaggccattcggaggcaatgtgagctcttggtgacattgcctcaggctttgcagtgtaatgccattcaccagagaccaggctagtagagtcagcatagaatggcaacagaagactaggacagcaaacctgggaaaaatagttggccaaaggttttcttatttttctttttgttagtattctatagtcaaagattttcacctgatgggcgtctgttgaagaggtagaacacagtctcaatgactttactctttttcccatttgtttttattttttaatactctcctccattcatgtgcatgcatactcacatattttttggaataaattttcaaaacgatgttttacttctttgtattatgctttaatttctcattagataattggagactgtccagtggtttagattagttagtacacaatctaagtgtgttcagagtttagaatacatttaactgtatacagtttttattctatttgggagttttgcaaataattagaatttctatagttttgtattttaatgtgttttacatcaattgggtaaagttatatagttttaactaaagaacaggaattattagattagattgtgatcacttagaaggttaataactagaggtggatttttaaactaaaaaaataattggtgcatatattgcaacaagaattagaaaaatcagaatgatttaaaattaagattgcaataaggtttaaaataaatgaacactcatcatgtgtatgtataggatcttttcctgtataatttgacttataaaaaatcgccatattcattgtatagaacattcagaaaaatacttaaatatactaaagtttgttggtacttttctttagttgtgaggctttctataacttctgttgctggtatgttctcagttgggactcaattattaaaattcatcacatattataaaagcatttgcttacctgtttgtatcttcctgacattttgttaataatattactcttaaaatcttgagagatgactcgtattgaggaaagagcataggatttgaatcataacatttgaattagagccctaatattgccacttattagctatgtgacctttagcaaaccatttaaccttactgaatctcaatttcttcatccaaaaggttgaaatctctttcatagtcttggtataaaaatcaaatacattactaaaaagtacattacaagcattaagtcactatttgaatttaaagcagcataaaatatatttaatgttttattcagatcctccccaaagatatgtggggttttcaataataatttctatacttttatctgaatattttgttgactttttaggagaatttaaaattgacatgctaatgtatgaaataattagaaccatctggctgtatgttataataattattttgctaagtgtcaccctcatcttggtttataaaacaattatccttagtagcctacataaagaattattttgaaggtctctcccgatgtaaggaatgagatagagctatgaataccttcatatatatacacacacacacaaacatacacacacacatgcatgcatacacatagttttatttcttttaccatatggttttttaaatatgtacaaacagttgtataatgctttttgttaaagcactatagcaagcatgaatctagaaaataaatagaaaccagcagaaggctctcagtgcttccagcaagaagggagcacattattctgcattttaaatgtacattcaatgttcttcttagacaaataaatacaagggggagcagcttttttttttaacttttattttaggtctgggggttaacatgtgaaggataaataagatcctttttgaataagcaaatattgagggaattcattaccaccagactagccttacaaaatatcttgaaaggaacactaagtatagaaagaccactaccagctaatacaaaaatgcacgtagacacacagaccagtgtcactgtaaagtaactacacaaacaaaccaacataataaccagctaatagcacaatggcaggatcaaatccacatatcaatactaaccttgaatataaacaggctaaatgtcccacttaaaaggaatggagtggcaagctggataaaaaagcaaaacccaatggtatgctgtcttcaagatacccatctcacatgtagtgacacccatgcgctcaaaataaagggatagaggaaaatctaccaagcaaatggaaaacagaaaaaaaaaggggatacaatcctaatttcagaaaaaacagatttcaaatgaacgaggatttaaaaacagacaaagaagggcattatgtaatagtaatgggttcaattcaagaagaagatctaactatcctaaatatatatgcacccaacacaggagcacccagtttcataaagcaagttcttagagacctgcaaagagacttagactcccacacaataatagtgggaggtatcaacactccactgatagtattaaacaaatcattgaggcagaaatttaacaaagatattcaggacctaaacttgacattggaccaaatggatctgatagacctttgtaagaactctccaccccaaaacaacagaatatacatttttctcattgccacatgacacatactctaaaattgaccacataattataagcagctttcgtattgcctctagttccattttatatttactaatttaaaatttttggaatatgttattcttttaaggttgattgaactacagggttcagtaatatttgtggctctctagaccaattatatagaaatggtctccagctttgccaacagtggcaaagatcacctcatggcgatcttcatgagacagccaattcttttggatagtttcattttcaagaatttcttcatttctttgaccaaatgcttgtcttcctttaacttccattcactagtcctgttacggatctctacggcccacagataacctaaaagcttagttaccccatgtctttttatttaagtgtggtcattctcttctttagaccatatattcatgtactggattcttttgtttctttcaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggtgagttcttataagcttaattgcagagttttgacatatgcactgctgtgtaatgtattttatttgagctcatctaacaattgtgctttgtgtgttcataaaacctttcctctactgtgtgagaaagcagttagcaaacagccacttaatatagtcatatgatgaatactactagttaatttcacaaaatagctgatagacaaagaaacctttcactttaatgctccagagtggccagtaggtttcttgcatttctctactctatcgcaggatattgcttttctctgttgctattgaggtcttgagaactattatgaatgaaaaatgagaattaacattggttaagtgctcttaggtatcagccctgcagcaatttcctctcaaacacattttcatgatagcatagatcagtctttctactattacttcatacttctgctgagtctactgctttgttctctttaaaattcttcaaatctttggaactggatcatgaataagagtctctttagctagtttgggtaagcaattggtgatataacttgtatgtcaaaaaaaaaaaaaggactaaggcaaaattaggtggctaggtagtggaaacacaaaccattttgaggataattttttagcccaggtaggtactcatatatttgggattttttaaattatagaatctcattatagaaatggactttaggaggaaagggaatatattgaaatcttaaggctcagtataatactatgacttttattaataaggataaaaatgattttcagaagatggtaatataagtaaaagtagcatcagtaacatattttgtcagaccgtcttcagaatttttatttcaatttttttccctaagtgcaattctattgtagacagtggtaacttctcggattttaagattaaaaaagtagttgtattcagttgtctattaaaaaaggcacaaaattcaagattttaaaaactaatcctatttggttcttctttaggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcggtaaggattctttgctttggaaaaacaagggcattatttgtcttgtgttgtagggagaatgatttttcatgcctaataataatagttaagattattatacttgcatgcattttcttctagaattgtgttaatagtttagaaatattgtgtattacagcactcaatgctgaaattataggtattaacattttactttatgcaaagagaaacagaagtccagagatgaagtggtttatcaaggcttgaagtgccaatgaatctcagatctcctgaactgaaactaagaaccataccaacttgcaataacaaagcaatttttaccttgtttctgggatcaatcacatattttgcatgtgtgaattccctgcaaatgagaaatttgctttaaattttttttaaataaaataaacattttagaataaaatggatccagtcattaaaatgactggaaaacctgtagtttagatatttaaggaagatttgcttttctgttatttatttccattgccccttatgcctatcaataagctattaacagttaccaggaaaaagaatcaactcactttatatctgtttttgcccctgactttatttttgacttcaggctcatagctggtgaagtggaggtgctaggggcagtgttaaatccaacttctccatggtagaaacaggcacacccttaggaataaagcaggtactgctgggacaactaaaaatgggttatgtatgtttcagaagacaatgctaccaagtatcttttgtgttacaaacttgtcaatcaaataatcccaggataactctgctgcacaatttgggaagctcttgccatacatttgttctttcattgccagatttaattatgtccttgcttcctcaggaaaagaaacaggcatatgggaaaggtgtaattacattcccattggtagtgtaataatattccatgacagaaaaatatagccaccatatgttgtattctgtaagttaaaaaaaagaattccaagcttctgggactatgctcagactgaacttgaaaatgaaaaatccatttatatacagtgttcctaatggcttattgtggtaacatcaagctagcttcagcagcagagaacctggtttcattaagacagagacttttaagctgcatgtaaaaatcgtaaaaatccaataattcaatatggctgccattctcaaatgaatgatgattatttctgctttgaccatggttctgtttcaataggacaggataaaatttaccgcaaaagtgtatttcttagaagatatatatatatatatcctcccttctagaattttacttaacatttgagtaacaacacttgcttttcagaatgagatgagggaataatagaacatttctagattcactctccccacataagttggtttacctgattgccagactctcttggtgtggtctgttctgccagtgtgctcagcttttaaaatgttgagtccttgttcttgttgacagattgaggatgcactgaaggcagcagacaccattggctacccagtgatgatccgttccgcctatgcactgggtgggttaggctcaggcatctgtcccaacagagagactttgatggacctcagcacaaaggtatgtatttttgtagacaatattcttaccaaccaaaaaaactggcttgatagaccttttcaactagagaaagttatgtagatgagaaattacattttctttattaaatcatgatcatgttctccaaaagcgtattccaaaagatgacacttttgcgagagcatgcagtgcaactcttcatgccaggatgcaatgataaaccacatggttcaaggtaaaccagtggtcactttacctcaaattccacttttatagtacaatctattgacttcaaggagatgaacttaattcaactccttcttcctttgtttcaaaatctactctcaaatatttaaaatgctaaaatatgttttagtggttaaggaaaaataggacataatgtctcatttttaattttttagaaataatgtggctggcatgggtgacatccagaaagtgaaacaaagcacattgagtagtttgactttactcaaaattaaggtgtctaaaatatacatggtataaaccactcaatacagtaaatgactgaactccaccaactgccatatactcataaaaacacgagagatttgagggtttataatttattttctatcaaaatcactttaacatattaggaactacttctttctttgcatgttagaggaaaactcttgagaaaagtaagctatgctacaaaaactaaattagagactaatgcagaaaatatgctccaggaaaacagagacttttgtctatactctatttccacaaaatagaacagtgcctggaaataccaggagttcaataatgtctttgaagaatgattacacgtgcagccaagaaacctgtgtaacttacatggcagtcatagaagtgaatttgacagaattactgtaagggctattttgggaattatttaggaaatagctcacggacagcttattgcttcatctttacttactttttgaactgaagtgaaatgagacccttgaattgttgacatagaattttgaaaacagataagtacaattcagcatatttaaataactacaatggcagacttacatataaacaacttgggtttcgtttttctaaagttgtgaaaattacaaaaaagggaaacatacctcacataaatgtttcttgttaccattctggacatatgaatcacatatttagagcaaaaacatgtttttgaagatagaaagtttatttcctctagcatgttagaggctccaaatattttcaatattaacaacttcataactgccaattgtgacagtgtatacatattctctattaatttttttactctataagaaaccaatctgaagactgaacttttcatgtaagaaagtttataataaagagaattttggaatgaaatagctttcaattatttatattgtactcaaataatcaatagtcccttaaatggtttttcttgttgaaaaaaaccctcgctcttcccttgagaataattagtcatatcattatgtcctaaacaatcccctattctcttgaggttataattagcaccattaaaagctgcattaacttatccaggtccctaaattaactttttacataaaatcgaagacttcaaaaaataaaaataaaaataagctgaggaaacaggtgaagataatttcaaattttccctgtatctaaatatccattttacttcattagaatgcaaaatacttttccaaatttataccctttgtttcctagatttcttcttttagcaggcaaccggaatgatgaattaatcattattaaattgttaacattggctactgaattttctaaccactttgagaacctcatcgtgggcagctgtggggacaaatgtgtcacattttcatttgcacgtgctggagcctgtagtgatgactgaagtttaaaaaaatcctattaaggcacattacagaaaaacttacattaaattattattttaatgcctattaataatttgaaaaaattcaaactgctttccctttcactgtcaatccaaatcaaatatattataagacaataagacatttctcccttggattatcagccactgcatgtcctaaggtcaaagattaccactttcctattttgggttcagtattctacccattgtgggtgtgccgtaaatatgaaattataattatgctaattcatatctgtctaatcaggcatacatgatatatgactcagagtatttaagcatttaggcagtgattaaccataataatagtcccatatgattcttctaattctcaagttttatatgccatcttggctaaccgtttacaaccatcatcatctcctttctcctcctcatcaacatcaactaacttttattgtgtgtgtcactgtacaaagcaccctcagctattttagagagagccagagtctttagacttatttttccatatttattcacacttatcacattttctggtttcacagaagcctagctgctgaaataatttcatttccctctgcctgattgctcaattattttctctttttcctaaattagtttgatttactgtcatatcagcactttgaatggcaagcctcaataatgtaaatcaagcatattcactgcaggatgctattcctagtacctcactgattttctgacacattgtgccttctgtgcaggggagaatggagacggggtttgagagttcagtgctgaccaggatttatgccagggtattttgccaaatatccttgttgaagccagtgctttttcttactctttgatatcttttgtcaccaatttctaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtaggcaaagtatcttcaagaactatagtaatgctttcagttcatgtctttgatggccaaggcagtctttataaagttgttgcctttaaattactatttctagttgacagactagtgataacattttggacaagcatagtattttacagtattgaaaatgttctcacatttaatttgatcttcacacaaaccctgtgaagtaaggcggatattacactgagttaattgaggaagagccaaaggtaagcaatatggtagaaataagatccataaaacttagtgttgagaaataagaagggaggttgagacagtttaaagcagactgagctggtaatcacccagtaaatgagaaaataggcacaataatagaaataagtttttcagaaaagtacactagttagataagagggcaaagatgataacttaggatttaaaagtgctaaatttggggtgtgagcagagctgtcaaaaaagggagttgagaatgtggagatggaatttaagaaataaaatagaaataaataagttgatacaaagacactggaaactgttggcataaaaggggaaattgaagttgtaggcatagacaaagtattcaaggacataggtatagaaagaggagagaatagggttgaactttgaactctgggaaacatttagatttatagggcaggggaaagaggaagtattactgttgaagatagaaggggagaataaagagttaagaggaaaatcaggtagtactgtaccaactaagccaatgcaagaactattttataaaagagctttgtttttggcagtatcaaatgctatgcaagaccaagactgattatttaatttggctcttttggatgtccaagagaacaatttcattgcaaagtcagttctgtgagctctattaaaaggaattacatggtatcaagtggtaagcagaattggcaaactttcaagaagctcattcatgtaaagaatgagagagaagctttgtatggttgtctggcaatgttgggagaagacttccggaggcagtgaagatctgagcgtgtttgaaggcagaagggatggagactaagattgcagatataaggggctatgatgagggaagtgaagatggaaagggatgagatacagaaagccagctgatgagccagtctgagtgataatattcaatgaaaggaagaacttcagaaataatttgagatgaagagcagggaagttgaagtcaatctagtaagtagacgattgaagccttgatagctacttactagatagatgaacttgggaaaggttagagaggtttctaaaagtactgtatcagagtaatatgggcaaaacaggaattgggggaatacctgatatcacatatatatcccaacaaaccctcagactgttctatgtcttgcatcgtgcaagtagatggttaagtcgctgaagttggttatttcaatatgccaccaagtaatgagtgcttcttggatatataggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactgggtaagaccagaataattgaccatgggtttgcagattcttttcagatagaaatgaaaaattgacagatagtggaagactgtactgcatttacaaactatgttccctttttctgtatgttagctccaaatcatttatagcaccctgaggacatgattattaatgagcttgttgccagattgaggtaaattatattgctagctggctttgtttgcaggctaatctaaacgaatcaaaatctaggtggctaaagcaggctgtgaaaaatctgcttcctaattgcactttgcagatgttgttaaaagtgcagattaatccttaattttagtcttcagctgttttcttcaggtgtatagccctatagcaaatagttgacagaaaatatagctcacttgactcaagcatgcaatacacattacttttattttatcaaaactccacaagactgaacagtgcggaattttttcacaagtaactgttacaaccaaacaaatacatctgctgtctatgtaacagccactagcaggcatgattggagggaaaggtaatcaaaacctttggtttctaataatatatttagcaccttacacttaaattatggcatttaaatgaacacaatatttacttctttatattttttttacgtagttccacagcactgcgtggagtggtgaaaggcatgttgccctgtacaggagtcacaattctgcattctcacttggttcttctgttgaccgtgtgattttgagcacatcactcattgtctttatcagtttcctcatttgttaggtggaagttgtactaaagaactcatttttaattctatagttctatgaattattttctcaaacagaataacccaaactgacattctggatgaagatagtcaagttctcaaagtgttagttttgtaaggagcccaaagttcaaagataatttggagacagagcaaggacccaaacttgaaatgcctacattttctgaccattatgtactctcttgtactagctaactccactgtattcttaggtacagatatgtatatgtacagatatgtatatattttctcaaaaaatattttgcagattctcatcttagtggaggttaaatacaaataaaggttaaactttatttatcaataaagctatcgattttgggttgaagaggtgaaggttgagcgttgtagcaatgcatgtagtgcacagagagtaaattctcctgtgacctgtgcctctatactttgtatcatgactcctattattccgcaagtggctactaaatattgatgcagaacagagaatcaagtgtcttataccctgaagtagaataataccagaaattttaagaaagaccaatttatgttttggtctgttttcaataattgctcgaagaaaaaaaaataaatttgtcttctttttatagctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtgagtccttggtttattacgcttttcttcttgttctcagttattttgttaaatttgtgacaccattgacagtgttaaagttgcctggataccatcaacacatggacagtgttaaaggtgcaattgacagtgttaaagttgcctgaatattagcatactaatatgctaacagtctctatgtgattgtttacatattacatatgttacatggccattttgctggatttgaaggtcttcctattcaaaaggtgaggccatatatctggctatatagtatagatacacatatgaaaacacattcatatacatataactgagttgtaatatattttataaccaaatcaagaaagtaatatagaatataatatatcaaaaagaccactgaactgagcttaagaattcaactttagtccattcatgcaaattgtggctctaacttcctgagacctcattccccacatctataaaagaagaggctggactagttcatctctcaggatccttccagctctaaaattctaaattgatatgagcatagtagattattaagccctctttaattatactaaaaagttctaagcttttaacatctttagaagattttttagaatgtgctgttatactatttgaaattaaagttagcctttgattattgcatcttcaaagatgcagtgttcttctgtgtgagaggaaagaaaggaattcatatctctgctgagattcactcccttgcctccttccaccaagtcctaatcattttctgcatccagaaggtttgggatagtggagaaaacatgaaacttggaaccagctggacttggatattactcttggcattgccacttattagctacagactctcaggcaagactgagtttcaggatccacacctataaaatagaaataataatacctaccttgcaggattcttataataccccctcttaataaatgtaatccatcattattgttattattaaattagtattcataaatgttgcatggggtagatgagtgctgaagtatgaacaaatctcagtctttctctatcatttgtctatctaccatttatcttagtttatctgtatctcatctctatttctgttgtggccagtgtgggagcttttagtctatgtatctaagttgattagagtacagagcaaaaggctgtttatgacatatttttccatattgttctttatttgtcccataacacagattatagcctaaacccaggccagccatttcagaaatgcatgtcactaatcacagaaaatatagattaaatctgtcaccaatacagggaaaaagaaaaagaaatgctttactggtctatcatattcacacatgaaaggcagaattatttctattttggcttccttaatttgtaagatactaatgaaagattttaaagtagtaacaaatcaacaaattggccttttaaattaaaatgtcttactagttgtaaaacactaaatattagttttttctccattatagttgttttaaatcttatttttcaaatcatactttttagtgtacaaaagaaatagaacgcaaataccatgaaaatctatgttgctagtgtttgcaccaaataaacaactgttatttagtttacatttcatgggaagggtcctttttaaataatgttcaccataaaattggtagttcaaggaacttgagaaaattatgtaatattttcatttggggcttcttatctgagggattttgttgtcaaacaaaaaataaaaggtaggggggagttttgttgtctaacaccttacatttagttcaaaaagtgagcaaacatttcctgagttcttactaaacgcaagacactgggaggatttaaaaaaggaatagattatagataattgagatacattgtctgcagttggtaaattcagaatacctaaactgacccgaatagacaatgaattattaatctctggtaaatattaaaagatagtacttatatatagatgctatgagaatatagtagaatagggttgaggaagcccattatagtcattccactggaaaatgtgaaatagtcactcaaggaaggtgcattttaatagtatagggcaaatgtggtgggaggacgacttgagcccagggggtccagtctgtagtgagccctatagtgccgctacactccagcctgggtaacagagtgagaacctgtttcaaaaagcaaaaatatatagagagagtattgaaaagcacaatttttgagcaaacatttatagatacatattcctttgttatacacgttttttttttaattgaatggatcccatgtaccattatatagattgtgcttaagaataataaaaatatatggagagttacttatagaactaatttcagataaattttaaatatgtaatacttcaaattttcttaaatatacccaaaatatttccttaattttacagaacaataaaatgtctgatttctggcagtcttttccatgcccaggctagacaatctataaacatattgtctaactcttcaagataccactatgacttgcaaattgcatatctgaattgcattaacaggttgtttattcctgctcttgtaaattttcccttatttctaattaaatttggaacagtgtgaaaaggttatctgtttggctttagtgatcattgaatatgtatcttgtcacataattgacatgaagatttcctaaactgacattagtggtaatttgagtctatttgaggaatcacaaaagtttactgaaaatagcattatgactgctattattttaaattggagaccaaaaatgcatagcaatctattattctatgaaaagattcaaacaatgtttatccagcgaaaataactgggtaggttgcaagatcaatttaagtttagttctgacatgcaacttgtccaaactaaatcaccacataatttttctaattgattagtgtatgatgagctgtaaagattgtggaaagacacattgaatttgtcacagaaagtttagtctcctcctacgttcaaaatcataatcatcagtatttgttatgactctcaaggttctattaatattaatgcttagctgtaaggaaagccaacctgtcttgaatactgactgatactcatttacaaatagtttctgtttcagtgttaatatatttctggtttctttttatttgccttccattctaaagaacatgcgcataaagcaagatcttactaagaaaaggtctctatgcttcaaccttgaatttcttattttaatactatggtccagagcaggtacaggtgatttcctcatcaatctcagcaaatacagctgaactccctgagtggtaaaagactgacctaatgaagatgcattataccaaaaccatggagaaagtgagagaggaagaaaaaaaggaacacctttttttttttttaatttgagaggctttatgatatattttttgttcttatttgttttataaaatatattttacgtccagttcagttacaaattaaagatacataagctctttctttcaatatgaggtcttaaacatgtattacaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggtaagatgttacaaggggcccacagctactagttgcttttccagaatgtagtcagtctggacattaaaataaaactgaatcacaaagtggttttaaatcagggatttttggaaaatttttaattcttttatagtattaaactggaaacatctatagatttcattagagtcttttacaattaatgataaattatcatttttatttgactttaagcctggatttaagggcaaattgcagttttaaaggatgattaaatagataaaatgtccccctttttaagtatacttagtactaatactcaagtagatttgactatattgacttgtcctttactattaactttattacatgttccttgaatgtgtaaaattgtattgtagaaaggaaggtgcatacaataatgtcccttagtatgtgccacttgagtctagaataatcttaatttatttgcttctctttctgtgtttaaaaaacagcaacagactataaaggcccacatgattatagggttttccatgtaattattttattggtcttactttcaggaaaaaaggccctacatttctcacttccctccactacttgcttctcatgcaaattaaatgccatgttaatctacttttatatttactgtgcttagagttttgaagtttcagctcatctgattttataaaaggtgacttgggcagctggaatctgtctggtcagaaatccctgaaaggctttttgacatttaaggaagcacaagcgttaatcctccaacagtatcaaaccgcactggttctacaaagctctactgaccattttatgtttgtgtgtgtgtatgtgtgtgcatgtgggatgagtcggtgaaaacatgaactttctctttaaaaggattcccgtctttgtaatttgcctgtgtagaaacagaaaaatgttgttagtgattttgaactcatcgcaacttttatgtccatattttgagtccttaagagacctgaaggagaggaagggatatttccttaattgcatccaatgtatattctcctcgctcttatggtttctaaatggaaaatatttaagccctactgaaattctgggagttgctattatctcttgatggacattttcccatgttgagtttcaaggtaattagaatttttctctggcggtggcgggtgggatagcagtgataagaagttattttagaaagccatttcaccttcatcatttattatccctatttcagtcttttatttaagaagcagctcatgacattcatatgtgtgtgtgtgtgtgtatatatatatataaaatttttttctcaggcaaaggacagtaaatagattttttccttaagtctagcaatcatgtttctgccactttgaaggagatgaaaaaggcaagcatttccaagttcccagctaagctgtaaaactcaagcaaatctctcattcttttctaacagacttataaaagatgagaatctgggaaaaatgtgtggaggttctttctttcacagggtaccctatgtatgagcaagaagtgcaggggctgcgtgtaaattattgcctgctcgagtgctgggagaaggaactgatttctgtttgttagaggtcatcattactgttcatttcaacagcagccgggaacttggtgattttgacagagagtgtaaggacggtggagggctgaaggggaaaaagaatgaagggagtgtgtaaatctttgcttgctttcatgagtcttagaaagagcaacttgctctgaggtctgatttttacagcagtcttatttcaggatgactggatcatcacctcttttgatttggggagaatgcggggcattatttttgatttttggaacattaaagtaacctcaaacttgtttgggggtcattatagacttcattacagtgatgttacatagcaaagctgcagtgcttggagatgaggtcttaagactggcaggatcttgcttgctgttgagaaatcatggatttttttttttatccagtctatcattgatgggcgtttgggttggttccaagtctttggtattacgaatagtgctgcaataaacatacgtgtgcatgtgtctctatagtagaatgatttataatcctttgggtatatacccagtaatgggattgctgggtcaaatggtatttctggatctagatccttgaggaaatgccacactgtctttcacagtggttgaactaatttacactcccaccagctgtgtaaaagtattcctatttctcagcatcctctccaggatctgttgtttcctgaatttttaatgacagccattctaactagcatgagatggtatctcattgtggttttgatttgcatttctctaatgaccagtgatgatgagcttttaaatgtggcacatatacaccatggaatactatgcagccataaaaaaggatgaattcatgtcctttgcagggacatggatgaagctggaaaccatcattctcagcaaactaacacaggaacagaaaaccaagtaccacatgttctcactcataagtgggagtggaacaatgagaacatatgagcacagggaggggaacatttcacaccggggcctgtcggggggtggggaggtaggggatgcatagcactaggagaaatacctaatgtagatgacaggttgatgggtgcagcaaaccatcatggcccgtgtatacctatgtaacaaacctgcacgtcctgcacatgtatcccagaacttaaagtatatatatatatataaaagaaagaaatcatggatttgactgtagtcctttccttccttccagtgaaatgactacaggattctaggccctccctcactgtatgtgcttgtgtgaaaacctcctttgatctcttaaaagtttcagtaacttaaggttctctccacctcacagtgtagatggccgacagctaattgtgcctttaatcacttagaaagtaagacagaatattaagtctttgggaacctgactgtaattacagggagaattaaacaaaagaaacatacattgactaggaaatgaacatggctttgagtatttctgttaaatgtcatcttactctagtcaacaaaattatgagccatgccatatctcaacaattataatcatggtctctctgatactatcattatgtaaaagctttaagaaaagtaagctccctgggctgaaatataccagcagagttactagttgcatatatttcttaatgggtcttaaaaacgcagtgtgttattctaaaatatgttgttctggaatattttcagatttttcacagggtatatacacgtacacatacacacatacaagaataagagtagacatctttttgtataaagattttggttttgagagtttatctcttttttcagttaaattttctactcagcttaatgacccatagttgtagttttacttttgagaaattgataaagtaagcttgaggaagaggctgagctgcctatcagaacagaagttattactacattgttttggaatatattaggattttaaaaaatgcctgccttagcacaaaaatcatagtgactgattcaaaacaattttttatttgaagtcctctgtgaggaaatattctggaggaataaagccaagccagatccgacccataaattctcactgactattgtatgtttgtgtgaatgtggagtgaggtgataaaaatatgctatctcctacaagataactatcaacactacaagttaagagatcattatattaattctagattttcttaccaatttggcttaactgtagtttcaagagactttctttaattccaaagagatgtaccaaatttagggtataatgggtaacacaatcaaataaagaggagcgagtcaaaacctgttaggagatttttctgagaacacaccactcaaggcaagcacctactctgtatgccatttgtggatatagttggcaccatctttatgtttattggaaggaatgtcagtgatgtcagtttcatgttttgtaactcagtctacagtctcgggctctctaaataacacacagaggcatgactgctatgtattttaaaccaaataagacatttagaaaaatgtttgccaaagaaagtatctcttctcctcttggcaggccattgatgacaacatgtcccttgatgagattgagaagctcacatacattgacaagtggtttttgtataagatgcgtgatattttaaacatggaaaagacactgaaaggcctcaacaggtaaggcagtgctgctctcattcatgccagacaccttcagtgcaatttttaaagagtcttcttcctactcttaagcatttggtctacattgtgattcaatgaggtagatagtgccattgttggaaaatagtacccgtagccagaagacaaatggcaggtttttttttttttagatgtttacctttagaaatgtatccattaatctttttaatcatcttctattcccacccttgtcatcagacatagtaataaggtcttttgaatgcacaaaattggtatacattgatgaacgtgtattatttaattatgaagtattatctagatttaaattttattaatcaattaaatgaatatttgttttctataaattttcctctacattctgaagtctgttttccccttttaatatcaatctatacattgctgtatattgaggagaaaatgcattccttttgcgctctactgtttttaaattgggacattcagttcagcatacaattaagccacattcaggtttctcttaacagactcttcacctctgactaatttacatttttatctccatcatggccaattatttttaaacttcattttatgttgagaatattttgataatgtagtccttaaaatctacttttaaatttttcatgggaaactgctggggcaccttaggctgatgaaagcatggatcagttttaaacatctatcttcaataagaggagcatttattagcagattaagaaagacaatatagtcctcttgaacttcttccctctgaaagcactctgaaatacactactattggaaagacgtcttacctgcaaactagggatgtgtttagagaaggaaaaattttgtttgtataaaaattgttctcaaatgatttgacaaaatgtagatactttaatcacttaaaatatctttgaggacagtggaaaatctcaaaacctggattgctcaactatttagcaattgcaacatatacttgggttactgtatttgcctgatcaatatgtgtacaaactaggtaataaaacacttgcttttctttttgagaaaaattaggttctttttcatctatttaattattgcccatgtcaaatgcttggttttgaaaactgaggaattctatctgacaaagatgaaaccagctatagttgcttgtaaatcatcctttctagtgatcacataaaatgaacagtagacagcaaataatttaggaattgaacctatacatttatcttataattttgctgacttaagtttccctttcttggtttatgatgccagcagaacttctgtgtaaaattatagtctgttctactgttctcagtttcaggcaactgatttcaaatgcctatgaaaccactccaattaagccacatgggggtgctagaaacttatagtatgccagtcacagcagtggaaaagacctggggtggaaaatagcagatgttattgtgatttaaatttccacttgacatacgttctgatttttggacaaattcaatgttttaattgaatagttttcgttacaaccagaaggcaggttgagattctaactaagcataaataagggtatattgatagtgaaaaaggtccttggaggattaaaacaacacactgttacagatcatttataatatttttctgacttccacattctgttgcatttatttgccgacaatttgacattttcaatctccattttctggcataaatatatttgtaaatagggatattttctattgttcataatgatctacatttaaaactctttatgtaaagctttatatcatttcaaaaatttcaaaaacttacacttaaaatcatctctactgtataaatttgtttttgatccagggaggttgaagtgtctattatatagcaaaagctaaagtaaacctgaagtggaactcacagatgatccacggcgttagcaaacctaaaccctgaactcattatctgagtgtcactttatggtttaattcctttctttttgaagtgtcattgatgcacgcatagcaatttgataatgattgttatttagcggtattagataaataacaagaatagatggccactaaagctacctgtctccatcattttgtggcacataggggtctgaagttgaaagaatacgacagctgatggaatgaatgttaagtatgtaaggccttgagtttccttgccctattttaattatactcaccattagtctgggtctgagtcctctgctttttctcggcccctcaatatccagggaggcttagtcatcaaggtacgtactgctccaacagtaacaagagctccctattaatgacctatagctgacttacatattgcgagtttggagagaggctgagaagattagttgttctttttcatttgtatttatttatggtttactttgaagatctcaactgcttctgtgttagaatggctgtctttagctgtaggcctaggagctagcgatttatttggtgtgcgttcagagaactccaaaattctcctgcctcaacatctatctctgctgccaatgtaccgcactccctttgtacttttcatagagatccttgagaagacaggcagtggggctctcacttgggaaaagagaagtaaattaagagaaaaaatatagaatgctagacgtgggttttctggttccacccttgtgcattggaaggagcagactatggagccagagattggtgcgcagtcctccccactgtagaatcagacgtacatcacctctttcatttctccagattcatgttctttctcttaatctctgcttctagtttttttgtgaagcttaatttatataagtataaatgacatctgacatattgtgagggcccaagaaaatttttcctcttttcccctgaaaataaaaatgctacttgttgtaataaaggttactttatgattttagatatgtattatatattatgattttagatatgtagatatgatagttaaatatttaaagattcattttcagactcacaatttttatttgcttttatattttgcaatgtatcatttcttaatttcctttatgatgcatcacttattttaatatcagacctattttttaaaggaagcaattgatagctacgatgcaaatgctattcttattaaaagataaatagctttcccttatgctaatgaataaaaattcctactctacagttgttaatcaatctcgagttctaaagtccgataaacacatttaatagcagaggatgagcatatcattaaattgatggtcagtctctgacttgtgtttacatatagtcatctgaaatgaagttcagaatttgagtcccaaatagactatacccacgcatggacacagggaggggaacatcacacaccggggcctgttggggggtggggggctaagggagggatagcattaggaaaaatacctaatgtagatgacgggttgatgggtgcaacaaatcaccatggcacgtgtatacctatgtaacaagcctgcatgttctgtacatgtatcccagaacttaaagtataatataaaaaaagaaatataaaaacaagaacatagtttatgtttgaaatgtaaacaataaatgtgcttatttatgcaatagcttcaaacaatatattttaagataaaatacaatggaaattattaaaaaagatatactcacatatttagtatatataaatattcacagactgagatggggaaaacaaaacaatgattgtaactaggtagatattatggaaataactgatgagttttccatgcctgtgagatagtagaaattataatcagaaacccttctctttgaaggggagagataaacatgtttcatgttcatgattacgtatgaagtctcatctttctgcagggtgatgagacaagagggataggtgtattaggccattcttgcattgctatgaagaaatatctgagactgggtagtttatgaagaggtttaattggctcacagttctgtaaacttcacaggaagtgtggtgctagcatctgcttggcttctagggaggcctcagaaatcttacaatcatggcggaaggcaaaaggaaagcagccgtgtcctatggaaaaagcaggagccagccagagagagggagtcggtgggggaggtgccacatactttcagacaaccagattatgcaagaattcactcactattgccaggagagcaccagggggttggtgctacatcattcatgagaaatctgctcccattatccagtcacctcccaccagtccccatctccaacactggggattaaatatcaatctgagatttgggcagggacaaacataaaaactatatcaacaggtatcagaataatcaactcagcatcctagctttgagtgcttgccccctcagaactcagtatgctgtctctaatacctgaatatagtagcaatggcaaccctcacaagacttctgaagcaatatctattcttaccagcttaggtaataaccattatttagacagcttcagccaaaaaaagatctctttcctgtttacgctcactgactttctccttttccacttaaactgcttattgctacccaagggcatggtagggaagctgactgttctaggcagttccccaaatttataggctggtgtagtagcattaactgacctagggtgataacatatttacagtggatttctttaggatttgagaagtttctttttactcagtacgatataagttgtgtcatgtaggattcgaatacttgttatgtgtatgctttggaatttagatgtttaatggtcaccaaaggtcttttaacttcacattgtcagatcaccctgcaaggagtttgaggaaaatgaagtctatataaatttttagtggaaccacaacatgtgcataatctctgtccattagctttcactgctaagctattgatattttagtctatttttcccatactcactctcccaatgccgacgctttcacatattgtgctcttcccatgtagtattttaataaataccaaaagaaaaatatccttactccgatctgtaagaaattataaaaatctcacctatagttcttttttccattagtgcatagattcaattttggtcatgtaaagatctcctgcctggagagaggaaatgcaggtaccataaatcaaataaagatgtcaaatgtcttcaccaactaggttcttctgatatagcctattccttattgtaaccaaataatgaatttataactcttaatactgaaacttgaattttgattcagtttaataattctgaatgccttccaagggtaagataataatcacaaaaatttttggactacatattaagcactgttctaagcacattattttgtttaattcctaacacaacattaagaaatcagtgattgtcctaattttattgatagtaaactgaggcactgagagattcagcagtttcctctacatcacatactaataaataacagaattgggatcaagtctaagcaggactccagaacccaggatacttgctatttaaccccttatatttgatatataattatattcttatatactttttactttagtaaaaagtaaacattgtttttatgtacaatgttgctatttatgtgagcaatattgtggatgaagcttagaaagaatacttacatgtaagtatatacctacatacttaaatatcaaatataatatatttatatttgtgtataccatagatgactgcttaaaaataatacatatatgtgtatgcttatatacttacatatcaagtatatggtatgtaagtgtgcatgtaaatatattaaatatatgtaaacataagcatatatatacacacacagaaacaggtttgcttggggtatagaaacagatttgtttagaggtgtagataacatctagaggaaataagaagtaagactacctaaaatagacagcttcagtttagaaacagtagccaataaaggggtgatagtcctatcatggtagaatcagcatatataatgaaggtttctactatattattaataaacaagcacaggtacaaatatccttcagttggactccccttgctataagtatgtaaggaattcaactataatagaacttgtgagaaagaactatttcaggactttacacccccaagcattattatttataataccaatttggattggcaattttatattgaaagacaatcatgatacttaaaaaaaaaaaaaagacacatgaacaggcaagaaaaaaaaagtgagagtacaattaccagctttaagcatctgcttatccctctggctgtaactgtttttaatttttttatttccttattttgtttttttggtttctttagctatttctgactgacatatccagcttggagattttattatacctgcctaaattgtataatttcgctcttttactggctaaaactaagctgaattaagttttgaatccttgcttcaagtgattatcttaaagaagatggccagcctctgcttttgctataccatgttaaatcatcaaagtgaaggttttctaccatttatgatgattgcttgttcttgtgcattccattcattttgggcaattttccttcaatggtccattttgctctcttgtttttatgtacaatgccgctatttatgttagcaatgttgtagatgactacttaaaaagaatctattttcattcattttacacgttcaaaagtaggagatataaccattgtgatacaatttataccatacgagtattggaagctaaaatttgtatttgtttccctattgttgacataaactttactatggatttatttacaaattatccagatattgcttttgtctaatattctgtaggtttcatgtggtttttttttgctatcttcactctaataactttaatattctctttcctctttactgcttatagtcaatatagttttaaaaaaaagagtaaagtgcacttttcaagggtccaatttccatccgaaatcactatgttcaatgtgataaactatgtccattggtgagtggtgaaaaatcataggcgtgcctattgcttaggaaaacaatctaggacaaccctggtgagttccacttgggcattcaagtgctaaattgagctcagtaaagttggccatttccctgcagccacaaacttctggcagatgtaataatgcaggtgtcacgttagctggaacactccctttgaatgtcctctcctacacatgctaacttctattgactttttatttaacttgctcatgaggcatggcaaaaatcaggcaagaacgttttgtgcttatgcttgattgaagtttctgggggaaaagtgtcacctaagagttgttggaacttagatataagaaacagaagggtcagtactttactttctgatgacaatgtatattttctggtagaaaaaaatcaacaactttcatcttaaactactaaatatacaagtaatttaaagaaagataatataacatataatcacattataatttttgtgatactttactatgacatgtttttgtgatagcatctattattttggatatagaaatgagaatggagatgattgaacactttagtggaacccattaatttgatttgcagaaaatggtcttatgtcttctcatattactactaactcacacgatattctaagcctcagtttcaccctagtaaaaacaaaacaaaaagaaacaacacaaactcccttcttattttactggtcagtcatgcagctagctgaatatatactatatgtgaagtaacaaactttaaagaaaaacagtcttaccagttattacatattaccattctatgctttcagtcttcatactccaagccatttatataatgaacctcttcaggtgtactaaaaaatggggcttatatatacaagtacttatttctttgtaagagaagagtaataccatgggaaattttataactctgtgaactaatgccaaaaatacattttatttttaatttgcttttatgttccatgtaataaaaggatattttaggtgatgtcataggtttgataggactccactaatttttaaagtaataatttattgagatagatataaaattttacatcaaatatttaatgttctgagagtcttcatttgttatttaaatagtgttttcatagttttggcaaatgattgtgcatttttgaatttgtgagagagtacttccgagtctggcatggacaagatgaatgttttgcttaaaaggttttcagagtaatattcagatgactcataaagtgcctattatgtttctgtatattaattattgtatgtttgctagttcataagaatatacaacttaaaaattttaagttgatttaaaataacacatactcagaatatgtgtatatatatctataaatagtcaataattaatacattattcctgtgttaatgtctctgaactaagcgtgatgggatatatatttacttgatggcatttctttttattaggagctggtattagaccaaatggtatttgttcttctattcagtcattatgtattgggtacctactatgtgtaaggttttgtgctagttccaaagccatttgttgatgaataatcactagttattagaccaaatggtatttgttcttctattcagtcattatttattgggtatctactatgtgtaaggctttgtgctagttccaaagccatttgttgatgaataatcaccagtcattgaatctataatataggtttataacctatacaaagagctatatatagacaggacacattaatggacatgtgagaagcagaaatatgaattcatgaaagtttagtggaggttagaaacaaaagctcttagctaactttacacatgttatctcatacaagtctcgatgtacagtttttaggaggtatgtgtctctatcccatattttatgaaagaaatgatgactcagaatgtttaagtaaattctccttactccatattggagccaggttttgagttcagaaatctctcagtccaaggacaatattctttccttcaatatatcccactgtcatgggagccaaaggaagaaggaagagagaatttaaaataaatgaaatagaaagacactttcaagaggattgcatggtttagagagagaagagagaaacagaattaagtcctcatttgatgttgggtaggtaggagtggaagctaggctataaggtccaaacacatagtgagaaacaggtaggtaaaggtatgaattctactcaggaactgacaaattgtgtttgctctttatcctatttatgctatttttcataacagtgaaaatctgactatgaagaaattaagatagtataagaagaaaaactaaagtggatattagctacctgtttgttcattgggtgaaatagttgacgccacacagtcttacttcattgttccgtaaatattgcatatatcctaatatcatcccccaattaaattgtgattttcattagggaaagtatccaataccataatgtcttaatatgtttttattataggtctttcttagcaaaaaattgtgttaatttgtatgaatgcagaatagagttcactgtggcataaggtataagtcataatttctgaaacagatacaaatggtttccaattctttatttaccatatattttcttgggaattgatatatggtgctttgtataaacactcaacaatatttgtatgataatataacaaataaactttcttggtagaaagtgaaaatcatcatttcttagtgatggcaaaggagggggaattgtagtggagcaaaatgcatatgattcctggttgttcaaagggattgaattcacaaaattcacaaaattattaattagaaaatacatagcccaagatataaactgactgtgttgggaaatattgtaaaccaacatctctaggttttaatttcttaaagtagttatgtatctactaattagctaggaaggctctgaataaactgttttttaataaaaagagatttatctaattgttttatattgtcaaagattatatacatgtaggcagtataggtatatcgtgaaatctctaactcctggtgagaactaaccagtgtttgtgtattcttgatcttcaaaaattattcacgttttcaaatttttgcattttctgagaagtttttgtgagaaatattcacagacattttcaactatatgaagggatatgattttattaaccagtgaagaaggttaaggcaaaaataaatacttatttaaaatacaggcatctactgtatatctccggtgaccttaaagtacatttctattataataaaggtgaaaaatatcactatcctatttttatggatggtgaaactgaatcacacgaggtgtgtgtcatactttatgtcacaccaatcagaggaaaacaaggaatctagcccagggctcccactttcagttttagtcactaacccttttcaaaagcttcttttgcgagatatgacttttaaatcagacagctggagatcagttcctgcttagcggtcaagttgtgagccacctgcattgttgaccccacttagagaggagacattgtgaggaatttgcccttttccaaaactcttgggggaaaacacaggaagtctggcagggagaaagccccagcaagtcacctttgaaaaatgtaaacaggattttcaagggtacaaagacccaggataataattttctttttaagttttgctttatttataataaaagatttgtatatatttatacacaatatatgtctataggtatcttttctttaaagtacaaataccttgccttccatgtttagggaggtgtgagtaaaacaactcttgagcgtagaatggaattaaatttacgcaaaataggctgccagagctataattacagaagctagataattagttgctgaccccagaatttcttcagctgctaatttatacttgagatgcctttatggggcataaagcctttgagtctgaccttaggatagagtcatgcacttcgtatccaaagactataaggcagcgaccatgcctcctaacagtggagtaaatacccgagagcactctctctctagaagatcaattttgacttgcagggagtcgtaagtatggtggccctcaccacctcaaagtgtgagtacagaaatactacacaggagaggaaagaaaacaaagggagctgaggtgctgggccaaatgtaggtgacttgctagttttgctcttctaaacttctcctcctgcttcttctcttctttctcttcctctttctcctccctgttggtctggttctttcccttcctccttttcctccagcaattgtatctattaagcacttattaccttcttggtgttgtgctgaacacttgccacatttattattttatctggctgatgagtctttttctcaggatggtggagcatgactacaggttttgggcaaaggtatttgcctatctaaggttgaagtaggtattttgacaccatttgcctatataactataatgatgataatgtaatggccatcacagcaatatccacctggcagtattaaattgcagttacttcttctacccctccccttctacccactcttcagctgataaactgacaagtatacagttgtagtgtcaagtggatggtaatttttgctttcatggattttaatgtgcattttctatgtcttcttatgaaaaaccccagataataaagatatctgctttccatgtaggtagtaagcctcatatcaacatagactgaatatgacatgtcaccaggaatttaattctagcattttcccacatcctcctaaaaataacttctccttttcctcctttctaaaaatggcttacattttttccttcaagaactagaaaaatgtagtcaaaaattattcttatatatcttacatttttctaggaaaaaaataagcagtagttattagtagataggcttctgttaagtttttaggaggctgagacaggcagatcacaaggtcaggagtttgagaccagcctggccaacatagtgaaatactgtctctactaaaaatacaaaaattagctgggcgtggtggcaggcgcctgcagttccagctacttcggagactgaggcaggagaatcgcctgaactggggaggtggaggttgcagtgagccaagatcacgccactgcacttcagcctgggcaacagagtgagactctatctcaaaaaaaaaaaaagttatttattttaacaaggctctaagtaattctttctagaagtcaaagaaagatatattgaaatatatttatatatttgttgcttggtacaacctaagtgatgtttggaaaactgctctgtggaaacatgatgatttaaacaaagatgatggagatgttttaaaatataggagtttcaaataaatttatttgcaataacaaattgtaaaacatcaaagagtgcccattcaatccctattttctatgaggccttataaagtgtttcttcttatctgttagatttaaattctgtacacataaaaatcttatattcaggggaaaatccagagttttgcttactgaatacatcttctttattttggggaaggcatacattgaatagatttaaaattataaataaatgtattcatcagaaataacagaagcaacatttcatagtatggacttaacccgttaatccaattggctcaagcaaaagctatttgattggtatcagcatcctttttttttctttttttttgagacggagtctcgctctgtcgcccaggctggagtgcagtggcgcgatctcggctcactgcaaggtccgcctcccgggttcacgccattctcctgcctcagcctcccgagtagctcggactacaggcgcctgccaccacgcccagctaatttttttgtatttttagtagagacggggtttcaccgtgttagccaggacggtcttgatctcctgacctcgtgatccgcccgcctcggcctctcaaagtgctgggattacaggcgtgagccaccgcgcccagccagaacactttcttatatacgaattgacataacttactactttggttaggcagtttccatttgtttttcatcttggtaaagacgaatggtaaaattcaaatttggtaaaatcaagggcagagagagagtcattgcatcttaaattaagaaccatgggccgggctcggtggctcacgcctgtgatcccagcactttgggaggctgaggcgggcagatcatgaggtcaggagatcgagaccatcctggctaacacggtgaaaccccgactctaataaaaatacaaaaaaaaaattaaattaaaaaaataaaattagccgggcgtggtggcaggcgcctgtagtcccagctactcgagaggctgaggcaggagaatggtgtgaacctgggaggcggagtttgcagtgagccgagatcctgccactgcactccagcctgggagagagagcgagactatgtctcaaaaaacaaaaaaacaaaacaaaaaaaaaaaacaaaaccatgaaaaaacaaaatgtggtttattatggctcaaaaattgcaattaacctacattaagcgtttttcttcatcattattccttgtattcatagagcataattatgacattatattcaatactaaatgagtggctttaccagattaagagtaatatcatgatatttctggattattagggtcattaaagattagcaaaaaagaacaggaaattcagaaaattaaaacttgcctatttaaagatatctacattatcagtttctcataaggtttcctttttaatgttgattttactgttattattactagcctttaaggtgaaatatagttttaagtatgccattttttgaaaactattacttgtaacattttagcattattgtgatagaatctgggtccacttagcactattagataattttcttgatgccatactgtcacgtgaacattggatctaggtattatttgctctgtacaagaaatataaagattcaagtcttcttaaattccttcaaagacctcattcctgtatagaaacagccatggtactcaaaaattaagacaaaatagtagtgcctacccaattgcctgggtttttatactttgcttttctaaatgccacttctatttttgaaaattgtcttttgcatttctcgtaaggaaacacatagcaacttgtctccttgaatgaagagaggtgacaaataatttctccactgatggcattattgtgattgtggcatggtcttgaacccgtgaaacgccaaaaataataagtgaagcagtaaaaaactcaagagagaggctagtgagggttcatgagtcagagaacatatatcttactcaattctcttattaaagcagatgtcattactgaacgtcaggcttagtttttttctgccttttggagtgttttttttttttttttaaagaggataataataaaattgcaaacccattccataattgtaggccaggtggagtgctcattttcacattagagcttgtgcaatctggagggaaatttggtttagtattactcgtgagttggtggatcagatgaaagccagtcaagtggaagagaggactgtgtgaagtgcgctggctcccctgataattagaatgctgcaggcgttcctccagtcagctaatagatttccccagctcctctgtgccaggtgaaaatttcctcattaaggggaatttattccatttccttttatcatttattattgaagactaagtgtgagtggaggaaatttcagagatgacagggaggaattttaaacaacaacaacaatatctacattggaagtcttagagaatgaggagaaaggcttgtattgtttgtaaaccagagaacacaccagagactttttgctatagaagccgagccatgctgtctcaccattaaaagattatggcagagtgtgtaaaagtctgatggtctggttttaagacatttttttcaccttctaaaatttcagtcattttgtgctgctaagtagaaagaaactgaagattatgaaaaggccagcatcacagccatttggtgtgttgttttattgtatagattctattatgcaatgatgaaagtctaaccttttgtaaagtttgcccttgaactctcaaagcaaggcaaactggcacgggaaagaatagttgtatatataatagcatattttagaggacacagttctgaaatatggatttaatgtgtatatgttcaaaagagtaaaaattaacataaaatactagtacatacaaatatatatcaaagaacagaaggataatttattatgcatattttaaaattgtgtgcttttgtgcaatatgctttcttcagctgatcacatttctagctgggcataaagctgtcttgatttacaacataatataaatggagtattccctattgaggtttcaaaaagcagtgttgaattataaattcagtatttatatttcttttagtaattattctgttttgagtttgtttcaaattaaggtttttattttccttcagaaaaataaaaatgttatagccttgttttgaaaataagcttttacctagtttgatcaaaaaaacaaaaacaaaaacccaccatgatggaaattggttttggcaaacaaaatggagggagcataatgtgggcagataaagatgaggaacatctatctgagtctccacattgttaaatgagctttatgtttgcttaagattatgcatcttgtatttatttgactctgaggagatttaacctgatctaaatcactgccccacaactaatgaattgtgtctttgaactgtctttttttttctttgattataatgggacacacaatacaattttgtatcagaataagctgggactaaagtcaattttctactgtgtataatgacatctcagccagcctggtgttacaccaaagagagaaaacagaggagaggaaaggtgaggacaatacagagaattgacctgcttccattaggagtaccttgtggaattaggcagcactgactgtgggaagggatctaacttgcctgtgcctctctaatggccctggtgggtcagtatcaacaatgatttctcagtgaggaggattgctaagtgttttgcactatttcatgatcatgtctaaagagcagaaataaccagagagaccatgaacaaaatactatagaaattacattactttggacatccaatgatcacacatacccaatatctgtattcaagttaaggtagatgaacatgaatgtactaatataccatttcaatttaatacattctaatttttaagacatttaaaaatattgtattctgttattgatctagttatttgaaaattgggcagaagttgaagcagtttttggctcaccaagaaaatgtcctaagaatcaactagtgagattaaaatatgcaaggtgcaggtctagcttgatacatctgtttcaaaattctcacctagtatgatttaaagggatgcctatgtagaaagttttcactcccattctgaagtatcattcacaatcattattttgtgttactgttgctcttctcagacattttctttaaattatgaaaactctctggtgtgggaaatgctatgggcaggggagcagtaacagttgagttagtcttagtgacagatggcttttttttttcgtcaccagagctgagtacaaaattaactcacttcactttttaatgcacaaggccaattcttatcaatcaacctttttcttttctctcttctttctcgttctcccttctttcttattatttttatttctttgctgataagtgttcagttttattagtaggtagaggcagaagactttgtatatttgctagagatgtctacatacattctgttagactcttgtggtgaaaaagaacaagagaaattatgcatattccagaaatgaaaatactacattcctgaatgaaaatactgcattgctgaatgtagacgacacaaatgcaaatttattgcatccctaatagaaatgtgaggaatctaattttttcttatttaataccattatttataattttcattttaaacaacatagcgacctttgaaaacctgactggtattccatgtaagaaggaatgcaaacaaataattaaagaccctctaaaaattgcaacaacaaacaaatagaaaaacctgactgaaaaagctaaagataactacatgacttctgcttatcttagcatttgaagaacccgcacttatggtgctgccgtgttagcccatggtcacaattatagatgtgatggttcttttcaaggcatgtgttttaagtgtatctggatgactgttcttcagagttaggattttagtcatttaagtaaaagtggttattgttctaatttagaaaaatcgcttatttgtcaagcacttccaccgaaaggctgagtgcatacttgcacataaacaaatgagcaattggtttgggagcatattcttggcaaggaaagtggaaacatacctttctaaaacaaataacaacaataacaaaaaaaaatcttcgccaggcgcggtggctcacgcctgtaatcccagcactttgggaggccgaggcaggcggatcacaaggtcaggagatcaagaccatcctggctaagacggtgaaactccgtctctactaaaaatacaaaaaattagccaggcgtgatggcggacacctgtcgtcccagctactcgggaggctgaggcagcagaatggtgtgagcccgggaggcggagcttgcagtgagccgagatcttgctactgcacttcagcctgggcgacagagcgagactccgtctcaaaagaaaaaaaaaatgtttcctctactttcaaaattaatttctctctctctctctttttcttgaaagtaaaagtaaccacaaactttggtgtttccaaggctctctgaagctctaaagtcacctctggggtaaagcctttccagacttctccattggcagctggggtcccctgccctgagccacggcttcaacttgtgcacacttctcccacagcacctctcatgatgtagacatatcattggctatttgtgcttcctaacatactctgacctcctaaatgtaagagtacaatatttcatcttccatcattaatacaggcaggacaggtctgatacagagcacgtactcactaaatgttaaagcagtaatgacaatgaatgtggctaccctcaccatccagtttcctcagtatgtttcccatacgtgccatgtccactgctgctctcaaacaatagccaatactgttgccattgcctattgtacacctgtcaactcctttatctacataaagttgaactttgttttttcttttttgaggtggagtctccgttgtctgagctggagtgcagtggcgtgatctcggctcactgcaacccccacctcctgggttcaagtgattctcttgtctcagcctcttgagtagctgggattacaggcacctgccactatgcccagctagctttttgtattttttgtagagacggggtttcaccatgttggccaggctggtctcaaactcctgacctcgtgattcaccctcctcagcctcccgaagtgctggtattacaggtgtgagccaccacacccggccaagttgaactttatttatagctctgttctcatccctccactgctgtagtgtttctcaagtacaacctttcacactattatctttctctggcctcacgtagcaccacatagcttatccctccataaagtgttttgaatcactatcatttcattgtctcaaatattgtttccttatcttctggggcagcactgttcagtagaaatttctgtgatgatgaaatattctgtaatctgcactgtctgacactggagccactgaccatgtgtggctgttgagcacttgaaacctggctttggtgactgtagctctaaatttttggtcttaaaagatttaattagtttttcaatttaaataaccacatgtggctaggggctgctatgttggatggcacagttctaaagcacagggcttggcacacatactaagtcagcaataatacttaatattggattgcattcaagaatttgacaggaaaatgcattgctctgagagaatgcttatcaaatacttgggaaaactaaattcaaaataagaataaaaagagaagaaattaaattcaatgggagatttaacacactgatttgagacagaagagaatttaggtgcaatagaaaaagcaaattgactaggaagagctgtagctgcaaaaatttaaactaatactgacactggaaatccagggaaatagccattatatacaccagcttgattttttcttctccaaactcagaatatgaattaattaaagcagattcatgattagaatgaacaaaatgcaatagatttaatccaattacattttattaacagcatttcatgaaaatgttttcttaaggcaagttagatcttctggcaatacactattttaatttcattgtattgactatcaaactattataattgaattgtattgtattaacaattacatgaaatagctggcccacaggtatctggttaaagatgcttttacagtagtattttattcttctgtcccttagctctttacaaattatttttgcatgcattttgaaatctagttatgagctaatttcaatcacttctttgtcttttctataaaataaaaacctagggaattgaagtttttatatttatccttcatttatttataatttatattcataaattatatttacatttaatttataaaatatatgcattttatttatatgtttatattacttatatttatccttcatttatttattttcataaatatttattgaatgctgtctgtgggccagataatgtggtagatttggggagtaatctggtaaataagccaaatgtattctttgcctttatggaacttaaatccagcaggaaaaagcctgattgacgaataaaagttaggagacattaaaagtatcaggtgataatggacatgctaaactgtatgattctatgtccatcgttccaagcaaaagaggcagtaaaaagcacaagaagttcagtgtggatgacagcaaaccaaaaggcttcacaaatgaggcttggctttagttggactttgaagggctgctgagggtcagggagaagttgagaaggtaaaaggaatgttaaaggtattacagatgagagaaacaacacaaataaagtctacgctatggaaaggagtagggggaaaataagacaaatctagtttgagtggaaaacaattataaaatgacaaaactgtcttctcaacatagacagatgggtgatattagtaagtagaggtaatttagggagaggatatccaaactgatgcaatgttgggacacctaggtgaagatgattctcaaagttcatatgcataaagacctggagcacaggtcagatgttggagaaccggccatggatttgggaattgtcaaccagtcatgctacttgcacccatgacagtggctaaatttagagagggagagagggaagacaaaagcaggtaacaaagggtagagccgtgggtaggggtagggggaaacccaaaactagtaaatggtagttttgagtaataaagtagagcgagaagccacttagtagaagccagaatatctttttaaaaaatagatcatcaaaagggtcttgtgatgacaggttgaggaaaatgaaaactgaaaaagggctcctggatttagagagtgaggtctctgattattactaatgagcacatttattagaacagtaaatgcacttgccattttttataaaagcagcagggaagaggtcgcatagagtgtgaaagcaggagatcagagattgtcagctttgcaaatagaagacttcatagaggctagaagattgagtgggttagttatttgtgtatttttaaaagataacaagacttaaatatgtttgaaggtggaaaataagaagcccttggtgttcttgaaattgaacttgtcaccgctttttattgtttttggtctaaacttgaatctctcttttctattaaatcctagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacaggtaaaggagtttcccttttcccccatcccccactgacaggatttctgtggtaaaacgtaggcacccattcaaaaggccattgttaataaaaagaggagtggaattaagaagtgacaatactcatccggttgatgctcataatgtcaccaattttattcagcaagtgattaatttttacttaaaagggaaagaaggaaaggacactaggatgtaaagataagagtgagtacctgattttcttggcctaactgaacaaaacaaaacaaaaatttaaactctcctctgctttttgacctgtgttcaaatatgtaagtagttaagaaatccttagtgtaattgaaggacttgaaatttcctagcatggtggctgaccctcttgaaaataatagttatctcctttggcagtaactttttacagggtaatactttatattaagtgccccatgattatggttcatttagtattcattgtgatagggctgggcataatgagctcatctagtattcatgacaatcacgcatgaacattcataggtgtgctgttgtgattttttttcctttggcctttaatggaagggatgtcttagtttaaagtaccaccagctggtttttgtcctttaaaatcattgacttttcactgtgtgctcaaggggcacgtgcatacccttaggtctcaagctttttgctaaatattttccactcagcgattattatctttcttccttctcacctgccttacaccagcttgccctgtcggccccaaattcttgctcactaagctgagttactggcccttgagagtggaattgatttccaaatatgttcaatgagatcttgttctccccccgttcatcccctatggctttatggtagttgtgtcatcccaccgctcagtgccacaggccacttaaatcctgcgcattaatttgcaagccaaagagatccttacgtataggtcattttgctcagattttagatttcatatacagctgcttttagagagctggtggggtaagtcttcctagtaaccagttgactataggaccactttgcgatgttcatgagagttactattactactagtgatccaatgccctgtttctcaggtgataactagaccacatcactattttctctctcttattttcagaattagaaagcaattccacgggtcatacattttcctgtttgcatactttacagtaataggaattaaaggaatatgtatataaagcacaaaaaatttagtcttgaaaaaattataataacattcttatttgtttattttatttgttttctcttacagattgatacactggctgcagaatacccatcagtaacaaactatctctatgttacctacaatggtcaggtaggaatgggcaaattggcctatccagaaagctctagatttcatagacagttcacattagggaatatatattttttacctctttggatatctaggtaataaaaaaaggcatcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaggcatcatgtgtgtcaggtatgatgatatgtttctgtactcagtcttttaagaactgccttaagataatgaaatcaaacaaatgaaaaattaaggacaatgactacatgatcatacaattatgctatgttctcatgactatttaatttaaaaaattctgccatatctattttttataaataagtagggcttgtataacactttatacttatgggtttccagagactaatagagaatacatgttaacaagaggaagatgagaaatacatacttaatgataggacaactagtttaattaaatggaataataacacttaatgatttctgcatcttccttttcttatttcctcaggagcatgatgtcaattttgatgaccatggaatgatggtgctaggctgtggtccatatcacattggtaaaataataaattatgtgtatataggactttacacaatttatatagttttcttcatacatgttaattccattattccaagaactatatcaaataaatgctgtaatatatgttttgcaaattaggaagctggggttcagaaaaataaaacccaaatatatacagctatttagtggtagagtgggactcaaatgcaggtctcaactacaaattctatctcctctcatttcactgtgtaacttaattttcatcctttttaactgaattgagcctttcactggagttgggaatggattagattttgacctgttatcttctagcatagtttttcataaggatctacatttactcaaggactttatacattagccagaaattacattgcagataccacctctgacctcatcctacgtaacatatatgactttcgtttacctcaaatgcaaaaatcttgtctgtttggtgcatgggtagagcattatgtaggtgaattaaaacataatcaccagagatatgacatttctctccagtcaattaaataaccactaaagattattacagatgcaagtatgtattttaatggacagtgatattagtcaacatatggatttaatatttaatctccacaaagcattataatatggaaatgataaaaatctatgatttgaatatatttaaatcttattctattactttaagcatagtttatttagtttttacaatgaactaagagcttcaggatatgttagtttaccaatctttggacaaatcttgaagtaggacaaaaatgttatatctttaccaccttagtcattgtcttagtccatttgtgctgctgtaacaaaatacctgagattgggtaatttataaataaattctcacagttctaggggctgggaagtccaaaatcaagtgccaggaagttcagttgtctggtgagacataggtctctgcttctaagatggcgccttaaaccttgtgcctcctataaggaaggaatgctgtctttacatggcagaaggcacaacagcacaaagggaacaaattccctccatcaaaccctcacccccagttttttctgagacaaggtcttactatgtcacctaggctggaatgcagtggtatgatcatggctcactgtagccttgatgtcccaggctcaagcactcctcccacctcagcctccctagaagctgggcctataggcatgtgccatcatgcttggcttatttttatttttattttttgtagagatggaatttttctgtgttggccaggctagtctcacacttctggactcaagcgatcctcctgcctcagcctcccaaagtgctggtattacaggcaggagccactacagctagcaagcttttctataacagcattaatctattcatgagggatctgcacttatgaactaaaaccctcctaaaaggccccacctcccagcactgttgcattggtgactaagtgttctaacacatggatttcaggagacacgttcaggccatggcagttatcttatggtgaaatagcctgaccatttcaccagcatctacctgtctactctctggagtactttttcttccttttcaaattttacctattcatgcagtaattctgcattatatcaggatccaaagaagactagtcaagctaataatcaagtgtgtgcttacttgatagttgccattaatatgccagtatatttgaataacgtgttttcacaagaatttttagaagacaatatcttaatgcaaagaattagtacaagtctgtggactttcaattctatggcatcccagtagacgtgatattttgaggtgtttaggccattattacacttcagatttctttatagaaggtcactcactctgcatgggtggccttgccaagtttaaaaggatatgcttggaaaagataggactcttcaatcaatcaggatatgtcagagctgcaaggcacctcagggatcattaggttcagccctcagacagcagattaagtggaaaggctgaaaaaagagcacaggtatcctcatcactggattaactatttttgtgtattgaggtcaatatattcactttgaatttcttttcagtaagtgagggttatttttatcattaaaattacctcccattaacattgaagttctaaatacttcaaatattgagattttctattgcagaatttagcatatatgacaagcccaatatttccttgctgtttaattagtacccatttttcctactactaatacagtatgcatcatgggtttgaaatttatatcttggagtttaaaaaattgaattgaaaatcattagcttccttagcctggactgactggtgatacatttctgcttctctttgtattgtaacttcgtgcttctcttatcccttttgccaatctcattgtctctgcaggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggtaagaaaagaaaaacagaaaaaaaagaaaaaagaagacagatatatgtagtatacactttatatatatgcattctggtatatagatgtatatagtaattcctcttagaagaaagggctgccagtggcatccattgtcttattttgtagtaaaactctaaaaaaaatcactccattcttatatttttgagcccctggcccagagtgattatttttcacataaagtttttatttacattttctttctaagggtttcagctagattgaaaactctacttggtaacatgtgccagatacatattaactaatacaagatgatccctcataaatatcttgcagagtgattgaattggtcatctagacatacaataaacagcctctttctagtttgtgtgatgtggtttaatgataaacagttccagttccctgaaaatagtcaattgctcacaaaagaccagttaattccttgttccatcagatgaagccattagtcttcagtttaagatcaatgagttcattgtgaataattttgcttcctttatagctttcacttacagttgttcctccattcccatcccaatattactgagtatcttcactgtgaattcatgtgattgcagattactataagactgtagaacaaaataaattatcttataattaaaataaaagctactggaaaattttagtgatgtccagtagttaggcctttgatattattacagttattattactttttaccagaaaatcatctctatgtggaaaatatggtcaattagaaggaaaaaagtactaaattggaaccaaaatacttaaattttagttttgactgacaacctcattgatttctttaagttacataaattctccgtgctttatctttattttaaatgaatcgtctgagtataaacacatgctacttgcaaatactgtgaagttaacatagagtttatggccgaagtcagattgtaaagtataaagtatagtgctagaataatgttattattttactattacaaaagaaagtagacaagtttaggaaggatgtataattatagttgtctacttgggcctggcctactaatcctttaataaaattgatccattaaatagaatatatagcattttttagacctctctctgacatggttgtttttaaatcactccttaatattcatttgagatagacaggtggggatcaaaataagtgcatcccacaaatatttctcgaacaccttgtaaatccaggttcagtatgatagacagctggaaaaacaggttcttatcttcaagacattaacaataaaactagtatctgtgatataaatgtgaaaagtcaaatactaatttaaaaatattaaaaaacattacagatgatagcagcaggcattttgcatataattaattatgtcctcatgaaatggtttaaagaaagatgaaaaacttctatgactgcttttggatacaattatacatggctattaatgagatttgtttattaaaactgaagtcagtattatagaaagaaagaagttggcccttctttgaaactaattggtatttaaaatatagtattactatatattaggaggtaatttaaaatatgttggcggacataatatgatgtacatatgtaaatgtagacaatggtacttctgtcacaaaacaagttaaatgaatgaattaatgacagacattaattagtgataggcaaaacccattagagaatgcatgactcgagacagaattgaggttcatttatatcatttggtttaattgtaattaaatgtaatcctaaaatactgcctaaactataaatcatttttactaacatgtaaattagtaaaatataaagcatcatccttctcattggcaggtgtacagatagtagaattttataaattggagataattcataaaattccaaaaaccatggccatttgtaatgaggcaaatactacttctgttagaaaaattttctcacatgacattctttccataatacatctaatttgtgcataaaaataaggactaaccaaagtgattagtggccaggataagttaagatgttctcaaataagcttgaagtatttccttttcatgtttttctattgaaaataagtttctggttcagaaatattcttgtgctatggtaagttagtgatatcaggttttaaaaaacagaaaactaagatgggtaaaaaggatgcaaacagatctaggtatgattaatggaattttgggagcttaatggaattttgggcctaaatattttagaaatctattaaacaatatttgaaatttagaatattttatttcagtagatttcttgaaactattcaggcctgatggctatgataaggatgatgatttacctgtgtgggttaccaggttctcatccctttgttcctacatgtcccgtgatatttggtgttggatcaatttgagattggattattccataaaactgtgctatattaacattttacaaacatgttctcatactgaattccttttgccctgtgggaaaacctgcacgacaccatcacactgttactctaaaagattcctgaggccgtgatttgtcttcccattgatggtctctgattctagtcgtcaatgatgagaatttggttttgtgctgaaagcttttctactactttccaaaaaaaaaaagtagttttttaaaaatagcttttctcttattctttaacattaactacacctgaaatgagccagaaaagtagagttaacttaagattctaatatttggtctattacttcagcatagctgaaagtgtattagtttcagcatagttgaaattacaatctatagagttgagttcaggccggggatggtggctcacgcctgtaatcccaggatttggggaggctaaggagggtagatcacttgaggccaggagttcaagaccagcctggaccccatctctactaaaaataaaaaaaattagctgggcgtggtggtgcatgcctgtaatcccagctactagggaagctgaggcacgagaattccttgaacctgggaggcggagattgcagtgagctgagatcatgccactgcactccagcgttcatgtacaagctctatacatgtatttgctagataagggatatgggtgagtcacttcacctttactgagcctcagtttctttagctgtaaaatggggacagtaataatcacctcagaaggatagtgtgaaagtcaaaacagatagtccaggatacatagtagaatctttattaaagagtagcagctattatcttactattgttttgaatttattgcaaaacagaatttttaattccttaaaaagcagaaatttctttaaaaacaagtcaatttaatacagctaagttgaaaaatattgatgtgtttattaaagccttttattacactttaagctcctatttagtctaattgactcaaacttttgctataagttgctacttctccctcagtttaaaaaaattattctaaaatccttcatataagagattttttgtgtccatttaatggagtaatttgtttttaagtctctaaaacattaacaacactgctgataaacccaacataataaggaaataaaaagattatagccaagagagtattttaaaggtttttgcaaaaatttatattgaacatattttaaaataaaaatagtttaagtacacttataaatatgcaaaatggtggattattattttcagtactgtttacaatgcctttaagcactcaattgcagggtgtttgtttagttacacagtaccgtaattgctctcatcagacagaaattagcctcatcccttataagagtatttcagaacaattttaaataatgacaaaatatatttggcacatatctatcattttggcagttctactaatattcattagtgggtcattaggacacacacaaattatgctaagctcaatggcctatcagatatatgatttttgatattaataatcatgtcttatttatttatacacttacggtatataggacctttaatgtttagtgtttaggcaggtattatcctaattttatacacaagaagactaaacgttgggggaaagttcagtcttgttgtctataaaattagacaagaaggggtgggtggtacacagaaggaaccaagttaggaagggacttcgactggaaatctatttcctcaccgtctcacgctggtttaccctcactgctacaacaacacctgtcttgagaaactttgagatttagtggactatttttttttttcttgaagttttgactgctaataggagatttggacttatggaagaaaatcttacacaaatgtctgaaataaggctaaagattctggcactgtttgtaaagcaagtagtgaggcagtaggaactaaaatcagttactaggtactgttgacaggtaccaaggctgcagccaaggagaggggaaggtggaaggtcatcaaagtggaaggacatcaaagtgggacctgagatctaggctggaactaaggggtagctaaaggttagataagctggaagagaagagaaaggaaacaacagccagggaagtttcagtggtgcagagaatttgttagtgggaaaatacctagttggagctaatgagtagtcttttgagctgagaggggtgataatagataagactggaaagtcttaagtgccctgggggtcaaaagtttatgctttattctctaggcagtggaaacctttggagaactctgagtgtaggagcaatttgatgaagcagacttgcttaatctgaatgtgaagtgctgagatggaggtgtacaggagaagggagtgttaaaagaagaaatctgtattcagttaggaatttccagcagtagtccaggaattaattgattatagcatagagtacatagcaaacatttattgacttgattttcctttccatttgccacacatgtgagtgtcacaaatgatattcacgtgtacttgtatggaaatcttgcacagattttagcatctaagtgccagaaagtaaaaattttgtggcatcatttaacagtattcattggtaggagagatgtaaatatcacagtcaggttaagaattatcagtaaggaaatagacacaatattagcatagttgtccattcataatgaagttattccaatggctgatattgtgagtgtattttccaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttggtaaggagagaaacaagtatctgtttctaatgttctattttgaagagctgcaacctgaatgttgactgaatgttgactattggatatgttaactacagggcagatagaatgcatacacttagtgaatttaaagttgttgtatatccatgattgcagttaatgctgattatgagttgatagcagtattctcattaagattcagacaatgaaaataatttcaaaccagttttgaacaagatttgatatttagaatcagaagctaggaattttatgtatttcagtgtccaatttacatttaatggtgcctttagagaataaagaagctgggctaccactcgagctaatgatacattctgtaattttattgcatattttaaactactcatacatttttattgttgtttctattaattagaatgaagcactggaatttgcaaagtctgtggactacccctgcttgttgaggccttcctatgttttgaggtaacactgtatattgttttccaaaacaatgattcaaaaattgggagatacagaaatgcatgctgtatgctaatagcactagggttctatatgtagtaatttataaatccattaacaatttccaaaccatcacagccagtttaaggaccaatgtgtggtcttctagtttaatgctttcccttcagggagtggccataggaagactacagttcttcatctagaagtgtagtgtaaggcatctccttaccaaacagagagggtagctttatattaaagaacaggacaatttaaaaaagacacacaaattgaggtatctctcgccagcgtgttttctgatacccagaaatgacagcttatctttgactattgtcagcaccttctgatagtgcctttgttttaaaattttcagtttttgagatccgattgtttaatagataaattataagggtgaggaacaggaacagtgaggatcttttatattaaactttaaaacaaagttttatcataaaagaagaagttgtgaattatcacttactttcttcagatgttaccacatgtaaggaacaacttcaccaaacaagggataataaaagaaacacaatttgctttgcacaatttgaaagtgtaaatggaatttgagatgggttcctttaaaatgatgaaaatgaaaaatttcaaacgaggtggaaatctttttatttaaatgtcattttgtgtaaaccatagtctaataatactacctgtttgaggagttaatgtaaactaatttaaacatgcacacatttaaggaaggatggaaaataaaacagctttgactatcacacttctttttccttttttgcaatctatatctttgttccagtttcacatactctgaatgataagcattattgctctagccttcctctcttaaacaaatgaagcaactgaaagccctttaggcagaaatttgtaataggataaactggtgaggtgatggatatataaataacttgattgactttctataatgtatacatagatcaaaacatcacacaatacctcataaatatatgcaattactatttgccaattaaaaatacattttaacattaaaagataaatttgtagtagtgtaaaagaggtaaatgctgctgtttaaaagcaaagtaatatttttcttatttttatttttgctttctgttactcctcctctcctaccctcccaacccattttgcaaatgtcaaaattcagagtaaattgatttcagatagcattttttctcaagcatttaaaaagaaaggatatagttgaaaaggttttattcacatactgcacattgtattagcaaatattactttaaaaattgattcatttgcaatctggttgagggagtagcataacctgctttgacaacagagcagtaggctaagatcagctgttgataatgaactctgaagaaacaggttagggaaatcaggttctgggctgaatcctgttaaggcttaagaattacctggaaccagcagagtgttaatgtagcaaatcagaaagggcaaactttggagaagtataatttctagagctaccaggattccctttgggaattaatacaggtttactgaccccctacactttaccttcttccatcctcagcttcgtcagttttatactttggttgattgtcctggtgattaaatggagaaaagtctcaatttagcaagaggcaccttcttattcagccccgactggaactataggttgtctggaactgttctgagaaccagtcaagtctagtattagcataaacctgacctgctttttttccccttccttttccagtgggtctgctatgaatgtggtattctctgaggatgagatgaaaaaattcctagaagaggcgactagagtttctcaggtagtgtccaatttctttgtagtgactgttatctcttaataaacatgtagtgacatttatctcttaataaaatgtagtgacatttatctcttaatgcaaccttactttgtatgttttcttttcacacaatgtgttagaatgagttttcttttttcctcttctaccctctagtctcctaaaagaatgagaaaccttgaaggcattaaattataactagacttttaaggttggtggaaaaagaggaatacctgtgcatattttatcaaaacagattttagactccaggagtctaaaaggacaatgatttttgtttttctcatgaattagatgctggtcagggtatttctggaattcccagtctcaagggctgctcaaccatgctcaccattaacaagtgaaagctttcctgatttttaattttcacatctgggaactttgcctagtcaaacatgcaactttaatagtaagtccctcactcaactattttttattttttcctgttggcacattcagtttgtgagttaatacaagcatttcttattttgtggcaactcagccaccttcctccactgccccccagcctttaccttctccttcagtgttacctcagcatgatccatttaagatttacccagtggggttattgatcttgtattgtagaggataaaagtaatgttttccttttaaaagctttcaaaagcttgttggggcttttttttttaagggggaacaattcatagagaagagtttgatgttaggcaagtggaatttggagggaggaagagtgaaatcaggagcatttcaaagaggaataaagtgcgtggactgtttctgcacacatgacgctggatcgctcttctgtgtatgatagctgctccccaaggatgtttgagtggtaagagtagataagaataaagagtgagaagaggcaaagagtgtaaaagaagaaaaccaggtagactttgaattcatgtttgtgtgcaaatcagatagcttagaagggaatctttccagtgggccagttttcactaatggagtgagacaccaactgtcttctctattttattcctggccaggggtcctgccatgcggcccttttcagaggctggctactgtactcagctggtctcatgtgagtgatgaggcaggtgtcccctcttgtctgcctcgaacactccttataggatctcagtacaatatttttaaagtatttttcctttagcgtatggatagaatccatatgggaccaaagtttaataatagagatgttgtgattgagtactttacagttcaatgttccctatcaaactacagcagcatctgggatactgaattcaatgactctagagtaaaaccagccccaatcaatcagtaatctatgtatgtattcatttatttatagcacctgttatatggtggcattgttctcagtatcaggaattgtaatcgtgaaaagaaagatatggtctctactgtcacataggacttctttttgctaggctcaacagacttcaaataattacaattaaatatgatgagcaatgaacatcgcaatagagaaaatacaggatgttgagggagagtgtgaaagtcttgggctccagtccctgaggaagggacttttaaattgatacctgatggttgattcagaattaactgggcaaatggcttacattgtgggagtaggaggaagaaaggaacagcatttatgaaggtctgaagatgagaaagagtagggagtttctcaaaactgataaagcattccttatatggctaggacatcaaacatgatgctgattattaatgatggtgcagaagtagtcagggaccagataaaggagactttattggtcattataatgagtttgaattttagtcatattttttattttaaaaagatgagtgtgctgtagtacacagagtgaattatggggcaagaccaaattcatggaaagaggtgagtgagttgttgctatagctcagggtagagatgacagtgcctcggattagagtaatgacactaaagatggagagaaatagtaagaacatgcattgaaaagaattagtgaatgaatggaggtggagggtgaaagaggataaaggataactcctgagttttctgccttggataactgggtagacagtgatgccatttattgagatagggaacactgaggaaggagaaaagtatagagggaggaattatatatttattttttaaccttttgaatgtgaactgcctgtgaggaatccaagtggatatgatttaaaggcaagggttattataataggtttggaattgaggaccaagatcatggctagagatagagaaggaaatatagattttgaaatgaatagcatatcactttaatggaagatttgagaatgaaagcaatcactgagggagagagtatagaagaaaaggaacagctaagacagacactggaggaatactggcatttaaggcagagaggagaagaaagaaccacgaatgagctgaagaaagaagcacagaaatgtagtttacagataccaaaggaagaaagtgtttttcagaaggccagccttgtataatgctgcatttcatgatagtggtcagaaggagtttgtgttcagaggcaaaagggatattcagagaaggattcagggaggagatagcatatgacctaggccttgaagggtgagttgagatttgaaagatgaagctgaggagaaaagatagaatacacgtggggaagagacacatggaagcaagtgaatgcagggcctggtaaaaagacagtggcccaggttgttttagcctatggtacagaggagaagatatctaaaccctggagatcttccctcaacctcttcatttagtatggagaaaagcaagtggggattatgttgtggagggcatcccgaccctgacatggaggaaatgagtgtgggaagcacttcaagatgagaagtgtctgaaacagccaagaaaggaaggacttttgaagattaataaataaaaatacttgattttacagttacaaatgtcatactctagaagtggcataagacaaatcaactcgaggtaaaggatttcatctttggcccaataagaccaaaagaaaatgtcactctcattctgagttctcccacaattctcaaagagaaatatgatttagggagttgtagtgcttagaaaagataagggtagaaagaaagaaatattctgaaccaataataatatgtcattataaagtagagaaatattcatgattctgacagcagagaaagaagccatattctgcttcctccttagtcccctcttttctctaattgacctggatgcctatacttgaggattcagaactcatggtcagtttgctgagcactcaaagttggagaaagaccctctgcctcactacaagcaaagaacaaccttgttcttacagcacagattaggtaatgagtttatgtagttatgttcagccttgagtattttgcaagtattgccctgatacttataatacttaaagtacatggcttattgacactatatacatagcgttagctaaatgttcggctcctctgttttccttcgtgacaggagcacccagtggtgctgacaaaatttgttgaaggggcccgagaagtagaaatggacgctgttggcaaagatggaagggtaagtgctttattctcatctccttcattcctgccttctcatcatttttttctttaacaattttgaaatattgacaggttagaattcataatatctataaaacaggtctccagtaatagtggagaagctgtaaaaaaaatcaaattctctgacaattcagttgatgtgtcatgggtatcatatttcctatgtttcatactgttagaatttctctgatgatattcaaaagtaattatcatcctgtactcatcattccttttgaatagattttctctctcattttcttttgtctgtgtctttccttttatgtttcaatggctattatgaaaacatctaatacttttctttctgaagttcccaatcgaatcctggtttttcttctttcttcatttcccatcctcctccctttttattgggttaataaaggcaaagtcaaacagagtaaagtggataaggataataatattaaattggcttaccatatcacatcttgtatttctaatacaatgaatacctccaacttcaaggagaaatgaaaatgtgaagaatattttactttagttttatagttgtattaataatgcatttgtgacttctcttaaaatgtagtaagttatgttgtagggagtctatgccattttacttgctttaaggaaaaatacaaacttagcattcatcttctgctttgcaaatacttcaaaacactactgaagatgttaaatctttttctctttttccttccagattagcatttcagagtagatcttgttaataaaaatggtaatggtatctacttacaacagaatcacataatcttgagttgaaacacctttagagataatttattccagccctccaccctccaagtcagatattttctttacagcatccctggaaggtggtcatctgttttcttttaaacactttggtgatacaaagctcaacacattgtaagattatatattgtggtcacttttttttgacatctcaggtattctttatcttgaactaaggtctgtttccttggaagtcttatccctgattttctgagtttcagagcaaaaacttaatctatttccttttcaacatcttaagtatttgaaggttgagatataaaataagaggaacgtgatacctatatatggaagtggagaatgtaagactggcctagagacatttgtactttttcaaatactgtactggtaaaataatgctggtttgttggctttatttggctctaggtttgccagcatatgtgctttccctaaggttttctcagatatcaactattgcacatcgtcctgtactccctcttttggaaatgttccaggttattcacatagtttttaaattgccatgttaagaaatggacatagaactgcaggttgctgagctcagtggggtggggtgcctgagctcagtggggtgaatgcctccccttttccagacacttcaccaaaaaatgagctcttattattttataaataagctcttgtaaaaaatgagctcttacttatatgtggtctgttttatccttacaaacattctatgagcaggtaccattgttattcttatcttatcagaaaccaagactaagtaagtaaagcactttgcccaggtcacagaacagaaggatggaaactcaaatgtcactgttttaagacgttgctaaatctgataagcaaatctcttatgtaatttatttaagtcttttatacctacccaattattctcccttactctcagctgcatcatttcccaaggacacacatattattaacatataggttatagtgattgagaccacagactttggaatctgacagataatattcaaaatcctaactcagtcacataccagtcacctgaacctgggttatttattattacattacttttatttccttacttctaaaaaaggactagaatatttttcctttcgactccttcctctttcaaacttccatttaatgatctcttgatgagatctttgagacttatttttggtccacctaagttataccatttacctagatagatattgagctctcccaccttcttttctttcccagtgcctaaaagataaagatattttaagtgcttttcaaatgctttagcttcctatcctgttcttaaaagtcaatatgaattggtttagttttactcttttcctattacttatacccatgctaatcagtggatgagggaggtaggctctcagccactcttagctgcctctacaggaaatctgttactgcacagagaggcagcattttctactgctctcatcaggaatgtagcaagggaactacttagtgctcagtgcatctgttaggaccaaaggggaggatgagggagtagcttccttgaaggaagtacctgaaaactttttctaaaatcctttttttttttttttggccaggttatctctcatgccatctctgaacatgttgaagatgcaggtgtccactcgggagatgccactctgatgctgcccacacaaaccatcagccaaggggccattgaaaaggtcatcatttataaataaaagtggaagggaaaaggcaacactcagaaaaaaacacctaaggttttttttttttttttaaagctaggtagcaatgtaagatatgctgcaggttaaatttaatgatgaggctaacttccttgctctgagtcacctgggtattctaaagataacaattttcttcactgtccttttgagcccctttggttgtatgcgagtacaggggttctcaaacttgaatgtgcatcacagacacctggagagcttgttaaacacattgctggactccatcccccagtttctgatttcatatttctggatcgggctccagaatttgcgtttttcacaagtcctaaggtgatgctattgctgctagtctggggatggcagttagagaactgctactcctggggattctaatgtttcagggccacacacaggtgagcggcatctgaagcaatgcttctcagttaggagtggtgaaacaggtgtggaccagtcacttgagaactttctggaatctatgctttcccttctcacccttgacttcacctccaaacagcactttttgatatctcttttgagctccgagagccagccgtataaagaacttaacaaaaataatgactctgccttagtactcaatatgcactgctaggtgtacatttagaacctatcatctttttttttttttttttggagacggagtctcgctctttcacccgggtgggactgcagtggcgcgatctcggctgactgcaagctccgccttccgggttcacgccattctcctgcctcagcctcccgagtagctgggactacaggcacccgccactgcgcccagctaatgttttgtatttttagtagagacggggtttcaccatgttagccaggatggtctcgatcctgacgtcgtgatccgcccgcctcggcctcccaaagtgctgggattgcaggcgtgagccaccgcgcccagccgaacctatcatcttaaataagctttgaggaggtcccattagtctttaggtatattagatcaggctcaggctcagctctttttagtgagcttttccagtgaccctgccatcagaattcaggcagacctgtctctctggttgtacattgggctggattctgaaggtctttgttctagaaggtagaggtagcaggatactttgtaatagcagaagcattaaagaaaaaagtccttggatctcaaatgtacttcagtttctcatgtcaggataaatgatcctcagaactcaggattttccaaatctctcagagctcaatgtgtcatagactctacttcgttttatacccaattacattgctgaaccactcttgtgagcataatgagtgaggagctcttgctctttgtaatcaatgccccctcttggtatagggacattctggctctggttgaatacagggattcctgtatgtgacatgcagggcttccctgcagggaaacactgtttccttctgaacataatatctaaccttgtagagtccagggcaacagaaaagcaacacaaaagaaatctctctggtttctttgcagtaccatgtaatttcagggcctgtacctcccagcaggtaggtcattacattgatatagaggttggactgcagtttctggtgctaaggcaactagactgaaaggatttcatttaaccctcaatgtaaaaccaggttatataattgtaggtagataggggaatttggcagagagataatcgtgtacaattatttgttcttttcctattattttgtgtgtatttattgcatattattttgttaatagaaacctaatagtgccctccattataattattaatgtagatatatagctgtctgtgaagagaaattaaagacatccaaatttaaggtactgtgccttttagaaagttttcaaaaactaagatatgctctttagcacactatacgattatgctttttaattcaggtgaaggatgctacccggaagattgcaaaggcttttgccatctctggtccattcaacgtccaatttcttgtcaaaggaaatgatgtcttggtaagaaatgccaaggtgcctgagaggacaccaccactgtgttacgtcatgttggtttgcatctctctggtaatcttctctgtgaacaccagacaaagagcaactgagacccctggatctgtttgtgtctgagtgtggaatgatgcatagcatataatgtctaccttatttgaaggcccaggctattggtggcactgataagtcagttacagctttgtaaagcacactgatccactgggaaggtcactgtatgccacctacagtatagtatagatggatacggtgagacagactatcataaataaatggaatgtgtagagtagtcataaattctgtgtactgaaattctgctttactccttacccagagacgataccatttgcaaaaatgataaatgaactagattagtcctaattaatttagtctacttagtttaactaatcggtaactgccttagtctgttttgtgttgctataacagaatacttgagtctgggtaacttgtagagaaaaggggtttacttggcttatgattctggtggctagatagtctaagattggaaagctgaatctggtaagggtctcaggctgcttccattcatggtggagagtggcaagggagtgggcaggtgcagaggaatcagatggtgagagagaaagtaggggagagaaactgaagaaaccagactttttaacagcccactgttgtgggaattaatttactcctaccagactctgattatcctttttaatttaggtgaaggatgctaccccaacaggatagcattaatttattcatgaaaaatccacccctcggacccaaacacctcccactagtctccagcttccatcatggccacactggggaccaaatttcaacatgagttttgatggggacaaaccacatccagaccatagtagtaaccagcattgatttacctcctactcgcagtcatttggtggctgcaaaaatgtattaagcaagcctctgctctcaaaaaatactgtaatttagtgaaggttgggaagaaggtaaatttgtagaaaactataaagtagagtatcacagttgctagaggggatgtacaaataaaatggtattggaattatagagcagagagaacgtatttgccagtgtgtgtgcatgagcatgtatttgagcatcctatgcttggttaggggtagatcataaaagacttcaaggtagattttgtattgtgaactggatctcgcaaaacggttggaattttgacaagttaacgatggtagagagattattacacatagatagaacatcatctgtaaaggtgagaaaagagcatatttggagagagtaaatagttcagttgagtgagatgattttactgagtaaaatgggtgaactgggaaagtaagattgaggccaggagggtagtataagataaagacagtgaggtctccaatgaagcaagaggacagaaggccttcagggactagactttaatctgaagccagtggacatccagtgaaggttttcaggaggggtatggcattatttgagctctgcattaaactaaacctgtcagcagtgcatgggaatgcaatttggaaaaaggcatgaaagaaagttagagttcaaagatactgactgaaagtatcaggaaaaatccaagcagtaaggagaaaagagacaagattagcaaaacaagagctggtccccagttaataacagctggaaaccagtggtagagagaatattaatattgttgttactggctctcaatgtcctctttctcattttgaattttatctcttcaggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggtaacattttcaaaaatttattagtcattttatgagttctagtgaaattaaaagaacaatttgtcatcaaaaatcttgttacttttaaaaccttctaactaaagggttggactagggatttacatttcctttcaataatgtactgcagttgtactataggcaactttatgtgaactgttgtacatttcaaaaaaatttttaaaaccatctagaattgtataacttcaaaatcaattagctgagtgaattataagctttttgtgcagctgacacatgatggtgctagtttagctggtaaatagaaatccaggacacaccttgttaggataaagcttgaattgtgccaactcttacatgacttttgtaaaaagggttagcctgtggggttgattaaattcctaccacattgaccacctttgcttagtatatattttcttcagtggcatgatttttccatttgaaaaattgagacagctgttgctgtatatggtgctgtgcggttgttgaaattgatgacacctttataaagagtgaccaggaaaatttaaagtttgttcactaatttccaatacatatgtatattttaaataataccttaataataaagccattgtgatctcctagctgcatcagtatgatggtgcacagaattatgacctttaactacttggctggacaggcatgaggattagtgatatataaacgtatttgaattacgtagatgaagagcacaatgaaattaatatatttatgtaacattaatattgatatatttatgtaaaattgacaaatttctgatgttttcaaaaggtttccgttcctatatgtactagtgacttcaaccataattgtgttacagctcagacttggacttttgacttttatgatgggaactttaagttgaagttgtgaattaaaaatcttgtttaagctgataatgtaggatgccttgaattttatagtgcattgagatggaatgtgactttttatgttgggaggagaggtggcattttattcatggagactgtgacaaacatatattgttaaatcttttagtagaaaaatagagaaattttttttgagaccaacgattagtagccactgaaaaatatttttttccactggagattctatatatggattttaagttcatgtttctttattcatagttataggagtatgcttatttcttttagtaaattgatatatgaatttttaactaaaaataatattgatggatagatatgcttttttttttttttttttttgagacggagtcttgctctgtcaccctggctggagtgcagtgccatgatctcagctcactgcaacctctgccttccgggttcaagcaattctccccctcagccccccaagtagcccccaggtagctgggattataagcacatgccaccacgcccagctaatttttgcatttttagtagagatggggttttgccatgttggcaaagttggtcttaaactcctgacctcaggtgatccacctgcctcggcctcccaaagtgctgggattacaggtagatatgcattttttaaatgcactgtatcttctagcttactcattccctagttagctttgtatataaatcttagtttttttcaaattacttagtaattgtcaatcttaatagccctagtgaggctaattggtatcaacagatggggaaatagggaagctgaaatgcagaaatatgtaacttgaccaagatgatccagtgaaatgactcccaagctagaattcccatcataatttagaatgggtgccagaatcaatggagcaattgataaaattcctccatgtaccagataagtggacacatagcgagaaacaagaacttagtttttcatgaattgcatcagtaaaataaatgaaaaggaggcactcctatactctagttcatatgaaagttctgcacaaaggtgtttccaagcagaatgtttttcaaagcttttaagaggtgtcaacaacagtttaatgcctcagaaactggcttacagacagccatttctggcaaggtggcttgttgcaagttcaaatgatcagaacaagaagaggaatgtttccaaagcctatcaaagagaaaaaaatgtgtttgaactctgtctggagagaccaatgcccagtggactttgaaatcattccaataggaatatgcatgggccagattagaaacactggtccagactggtctcaggcgccctatttacagaattaatttgtgattatttaacctaaagttttggccaagagctcaagaaattcttggaatggagttttaaagccatctttcaagtcggatgcttggacccaagagattttttacatgtctactgtagcctaagtgaactctgtgagagatgatttgctaatatatttatcctctcttattcattttctacttttccctcacataatttttctccctgttttttttttttccaacaggctcccatgttttcctggccccggttgagggatgctgaccccattctgagatgtgagatggcttccactggagaggtaactagttaataatccatggaagctttcattaaatctactttgaaatctatggttttatgatttgaatacagtaaaataaagggaataaaaacatctgctatcagagtaagactcaaagagcttatgaattttgaatttaaaaaatattttacttctattttgaatagggtctaaattcttatttatattttaacatgggaatataatacatgtgttactaattcattttcacatgagaacatcttccaggtatttatctagacatccaagtaaatatcttctgtgtcttactttttatttaaaggttctcgggtctctctgtaacaacacctcattccctgccttgctgccatgaaattagatcatttgatttttactagtaatatggagaatgacagcattataaagatcatagacctaaacattgtggaatctgcagatacatgcaaaattttaggactacttttaacctcctggggattatctaaaaactataatggaatcggccactggatgtccctcttcacttgtgttggggctgtgtcagctgaaggtttctttaggattgtgaaatgtgtttcttgtaaagagctgtcagattctagaaagttctctccatgtcagtgtcaggacattttatgaatcacctagcccttgacagacttactagatacaaacttcagattctcatcagtgcatatccgagtggcaatatcagactgtgagccatcattgtttcctcttggtattaaggaaaacctaaaaggataaaatacttaattgcaacaaagtacgtgatgttttatatggttgcctggttacaagcaagatctgtgatgagaagccaagtgagacaagaaggcaggcagtcaggaataaatggctgtcctgtttgtatttggactcttagaaaggggactctttgcctctttgttgcttcttttaatttaagggcaaaaaaaaccttacttttaaatgaaggcactatgtacgtttcatctccagtcggtttaaggagacagtcttcaggttcttcttgatcccatggtcgctactactagtaatgctgattttagatggcccagggttcagatcagagagagatctattttccttcatactgttttatttttctttcttccttttttttttgaaacggagttttgctcgctcttgttgcccaggctggagtgcaacggcatgatctcagctcattgcagcctccacttcctgggttcaagcgattctcctgcctcaacctcctgagtagctgggattacaagcatgcaccaccacgcccggctaattttgtatttttagtagagatggcgtttctccatgtgggtcaggctggtctcgaactcctgacctcaggtgatccgcccgctacagacatgagccaccgcagccggcccatgctgttttctttagcatggcaaatttgttttcagtggttatgttcattctgcatccatacatatgttatgggagttattgaaatataaaaataagaaagaatgagaaattcagctcccctttgttatatctgtttctcaagtataaagagaatttttcttccattatttgaaagagtcgttaattccaagtgtcatacagtataatattacgaggtctgttttattactgacatcagaattctagcttagtaaaatcttaattatgcttcaaagagacattttcagtgtccaaatggcttgttgtaggattaaataaacattcagctactgatataagtaaggggcattttatgttcctagtggtaaagtggggatattagtcctaatctttaatggcacatttaactactttctatggttctgtagaaaatttttaaaacctcgtctgtgttgttgcatctgcactatgatgggattacccaattcttttcaatagaatttgagactcattaacttaggttgaccttatttaagttagttgcccagtacttgactgagtaaaatgttcactgtggagagaaaagcagcaaccacatgtactggtgaccagctgaaggttatagtcataagaacttttcttgcacagaaattgtaatttgcttaagaaatgaatttagccatcagtggttttttttttcttttttttcttttttattattattatactttaagttttagggtacatgtgcacaatgtgcaggttagttacatatgtatacatgtgccatgctggtgtgctgcagccattaactcatcatttagcattaggtatatctcctaatgctatccctcccccctccccccactccacaacagtccccagagtgtgatattccccttcctgtgtccatgtgttcccattgttcaattcccacctatgagtgagaacatgcggtgtttggttttttgtccttgcaatagtttactgagaatgacgatttccaatatcatccatgtccctacaaaggacatgaactcatcattttttatggctgcatagtattccatggtatatatgtgccacattttcttaatccagtctatcattgttggacatttgggttggttccaagtctttgctattgtgaatagtgccgtaataaacatacgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggtttagatttgcatttctctgatggccagtgatgatgagcattttttcatgtgtcttttggctgcataaatgtcttcttttgagaagtgtctgttcatatcctttgctcactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagttgcagctttctacgtatggttagccagttttcccagcaccatttattaaatagggaatcctttccccattgcttgtttttctcaggtttgtcaaagatcagatagttgtagatatgcggcgttatttctgagggctctgttccgttctattgatctatatctctgttttggtaccagtaccacgctgttttggttactgtagtcttatagtgtagtttgaagtcaggtagggtgatgcctccagctttgttcttttgacttaggattgacttggcaatgcgggctcttttttggttccatatgaactttaaagtagttttttccaattctgtgaagaaaatcactggtagcttgatggggatggcattgaatctataaattaccttgggcagtatggccattttcacaatattgattcttcctacccatgagcatggaatgttcttccatttgcttgtatcctcttttatttcattgagctgtggtttgtagttctccttgaagaggtccttcatgtcccttgtaagttggattcctaagtattttattctctttgaagcaattgtgaatgggagttccctcatgatttggctctctgtttgtctgttattgctgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaactgaatactctttatttccttctcctgcctaattgccctgtatttactctaatggtggttctgtacctgtgccaaatgatgatatacatggcagaattgactcctatcaggttcaaatataccacttgttctataattatgttggctatttgacttgtagttatattgtagcacaattaccgtaaacctaaatggaacttctgtatactctaacattactatatatgttagtttgtttggaattgttttttccccatatggctgtggtattcaggactagtagcaggatattttgtttcactttatgaaaatgatgtttttaaaaaacaggttcctttgaggttttcatggagttattaaatttctcagaaggctgtctcataagctctatgaaatggctccaaaccaattcagcagttacgcatttctgctactgaccggtaaattcatgcacggctgcatagtatatatgacacatactgttatttaaacagtaagtcatattaacattcggaaacttaccacattatggaccagaagctgtgatttgtatccaaataactctcagtagaatccagttatgttgctccattgagtgttgttggatagaaaaagaattgcttattcattcattatgcttaattaaaaacataagatacatctgccctggccagccttttaatccctggattcagattgcacaggctttgggcaacattaataaaatctacagaaggagtctatgagtaaagtactttccatttgtgcgtgcatgtgtgtgtgtgtgtgtgtgtgtgtgtgtattttaattttaatttttggtaggagtggttgactattctttgcatcctctattttaattttttatttatttctaaacaggtggcttgctttggtgaaggtattcatacagccttcctaaaggcaatgctttccacaggatttaagataccccagaaaggcatcctgataggcatccaggtaagtggtttgtggctgtgtgcttgcccatggtcatacatggtgagtggggaggggcaggatagaatgttaattgtggtatagaggaagggagatttgttttacgtttccgtttatggcaacttccaggaagaagggacatttgttctctatttgcttcctgattttgccttctgttgtatcagcccgtgcaaaaataaaatacagacagaaagaaaatgtttctagtgaagggatatttgttctaaatgggatgcagggtactttaaaaaatgaatctcttattctttggttttgtcttttctatatgttttactcttagctctccatccttagttcctgaacataggcattatatgaggttggatctcacttcctctgtttctcttgatatttctctgtctcttgattttcccccttgccaattcatccatgtctatagtacctactcttctatctatagctaccacctgtaaatttacatcctcagccatcccatatttccaacaatctgctggatacctccacttgaatatctcaaatccaacgtttctcaaactgaagtcatatctgttctctcctgaccatctccccttccttcctttcattcattcagtccttcacatttcaatcacttctaaatgccaaggattcaaagttgaatacattgatgttatttgattaaatttctcaacttaacactccagattgaaagtttttgaagggtagtgacttaatgggcctaatacagtcagtttatttcatagtatactgtagaagttcttgaaatattattcattggtaagccttctaggtcaaagtagggtgaaatgaatatctttatgcaataaaaaatgcactgtcaatttattgatgtaagttaaatataaatcttagggcaaaatgataggaaacttctattactatttggaatgctttttattactattcagaactacttttattactattactaattgcaagagtgtacaaactgtcctgtttataaatttcctgaaaaaatactagaggcttcccaactggtcattcatttttatttgagattagtaattcttgggtcctatgaaaaacaacaaatggtcttatataatatccctgctgtgcttttaataagctcaaactctgcatggctacataaaaatcaataaaaatataattagaacagtaccaggtattctcaagccagtgggtgattattttagattccatctcattagggtgtcttaatattagcaaattagactctggagactttacaggtagtggctttggagaagtttctgcaaagagtaacttgggattttgctttataaaggtaccagaaggacgacggtgaatagttagagcagaggctaacaagatgacttgcaattgtgaagcttaatggcagtttagagacaaatcacaccatatgatagactcatcatgttataaatgggtattaagtattattaagtcccaagtaggagaatatttgcccaacttccagttatggcttaaagtttaatgtgagacttgggggcattcagaggagaccatgcccttagtccacatcttcacatctaatcataatagtgctaacattttaaaatgccactttaagaaggcagtgatgtataaaattgtgccttgtttggttctagtgctgcagggaaatgtgaagcaaaaattaatttgatccctatgaagtatttgcgtaattttggcattagtggacagaattttgctttgtaggggaaaaaagggtttgttagaaaaaataatgttttcttaaagtagtgagagctggctattgaaaatctacctttcaatactttccttttaaaagaaataaatgttctagcagctacatgagttgttgcgaagaactttctgcacatgagagcatacggacacagatttaaaaatatattaaaaagtacttaaaggaacttaataaaattatacttaagaaaatatttacagccatggcaaaattgatcagctaatgcatagtttcttcattactatatgtaggattttcattcatggtgtttttaaaaatgcttagtctgataaactgaaaaagcgtgacagaatatactaaatggagagttaatagctataaaacttacttgactacttcttagttagtatggggccaaatctaatctcaactttttaccacagcttcatagcaattgcagataaagtaattagggttccatattttaggatacattgtacttttaaaaaacattttatttaacgtgatcctacttggtcagaagaactcatataaacacttttggatatattaagttagaactgaaaaatagcacaaaaaagactgctaatatataaatgggggttagggatagtaaatccaatggaaggcatctagttgaaggtgagttattatgaagttccaagagaacttgttatatggcagtctttctaacttttaaatttcttctctctttcccaccctactcctttacacatacagactctctgtttctggtcttccaaagttaaatccaataggtcaaagtatctgggaagtttgaaatattcataacatcaatcttataactaggacttaggataaaagaatcaagatgtagattttgtcaaaggattcttctcaatctattacattccctgtgtctctaccaaggcatttctaacataagaaaggcataacacaggtttatatggcaacaaaaatcatctttgattttcctgtaatatttctagccacctttcatcgcattaggatttatttttagttgctgtgagtaggcaatctgccttgttttgaagttttctggaagaccctttaacattaaatgatttactctagagtagatcaagagcactcactgtgttttcctctctgattgggctattcagtgatgcttgtggagtggcaagtaccaatctgacatctgcgcttcagcatcgctcagaaacacaaagcaagcattttatttgaaaagacaactccaagtgacatgaataaccttttatctttaatatggaatcattaggaacaaccatagagttgtcaatccagaggtccccgtagaatccacaggcatcacatagtattaacttggctttcttttctgtagccaggagttggataaatgtgaaaatgatcattggaggaaatatatatatttttcacttttaaaggactgtcttctttataaacatttccaagaaaataaatcagcttgtacttttcacctttcgtaacaaatggtttcttacacaggtattttcaatcagcttttaaatctgaggctactcagatgcaagctgacagctgtaatttctttttgtagagaggctgttttatgtgtcacaagtgttcaatacatgtttgatagaagtttataatgtgcctatggaagccaacacccagaccagaaggtagagtggtttcctggctgggaactgtcgatactgtcatgttggatatttatcttttccacctgggggacaacactgaaacagctccataatgaggttctgcctggtgtctgcaggtcttagaggacttgctgacttattttactttaaaatggcaaagaaaaaaattacattctagtactcctcccttaatgtttttcgtggtgattttagccaaggttaatgcaatcttgacttcatattacacaatgagtgaacgatagtcttcctatcccctattcccccctttctcaagcttaagtatgcatcaaaatcacctggagggtttgtaaaacaacaaattgctaggatccactcccagagttcctgattcaatagatctggggtggggttcaaattttcatatttttaataaattcccaggtaatgctgatgctgctctgccagggaccacagtttgagaaccactctacttgagcgatggtactttagaaacctggttaaaagttatgttagcacttattattgtcaaacatattatcagggaatttttgctaggggaaagtataaaagattgaggaaagttgagtgcatgattaatgtatcaattagcaagtgttggagatcattatgctgagccttctaatgtgatttggtacttactgaagtctattctgtgtttagcagagggtcacaatgtaatgttccatattaggggtatttaacaacatttggaagttcattttggacatttcatatatatttgttatataccaaggaatcttaaaacatgaaaaaaaatttatatgccatcaaatttagccctttgccttttctgaggagaatgaaacttgaattgtcttattcttctgtctaaccaattgtcctgatgtcactaagagttattctctaattttttacttgtttttttcttttacgtctaaccatgagcttcttgcatctaagctcatttctttctgtttggtcctaagtggaaatgaaaagctactttcctgggcatggttaaaattcatgttctataaggcagtcatgaataaccactgagcctgcctcagctgaaattcatccagttacatttatctattctatttaccaatagtttcctcttataaaactgcagttctgggattgagggggccagaatctgaaagaattttatatttgaacatagtctttggggtcttttcttaggatttagatctgtgctcagaaatactctgcaagtaaatattagggggtgttatgggctaaacattatcaaaattgtgcaaggatcacatgtgttttattgtcacagttcctagtttctgactctgaaataagatcatttgattttttccagccatcactaatatggtttataaacaggttacaagacatttgctgaagtaactagctcatgtcatctgtttaaaacctttttacaagggaaaccaacaagaatgttcctatttaaagaagaatggatatgtttttaacagtgtgtgattttaaatacgccagctcagttactcagacactcatgttaatgaagtcaaggtcagggtttgatctttgggtaggtcacctagtgttgttttctttcattctgaccactatcttgcaaacactagctcttgatcacaggaagtatgttcagaaatagggaactcctgatggcaatggtcaggaatccagggaaggtaggggctggacactagacaggtccacctggggtcctaggaaagacacagcaatggactacaggaaaatatctgaacagtgagatggagcattagggaagcctgtgtggaaatgaaatgcgtataaatgagggggcagtcagtttgggttgtaagtgtaatcgtgggtagaggaacccatgcttggaaactaggatgtaagggcaggaatctagtttttaggggggctgaaaaaacaattattgtaattataataatatttattaagaactattaataggcaagtaactgtgctaaattatagtagtaacacttaagtagtgcttacttctaaattagtttattgaacactcatactaatgtaagaactgttactattcctgttcaacagatgaggaaactgcatcttagagttgttaagtaagatattcaaggtaacacagtttaataaggtgtggagcctcaaaaaaaaaagttgaaatactactattgtcatcactgtttttgagtgaagaaatgaaggcaaagacattaactttttgaagctcataccactagtgaatggtgaaagccaggatttgaaatgcagctaactgactttagagctcattctttagctacaactttttattgcctcagagtaaatgaaaaaagagttccaaagattgagttattgcagggactagtgcataagctactaggaaaatggcctagttattgaagagcagtacaaaattagaacttagaaataagagcaagttgagcctgggtgcagtggctcatgcctgtaatcccagcactttgggaggccgaggtgggtggatcacctgaggtcgggagtttgagaccagcctgaccaacatggagaaaccctgtctctactaaaaatacaaaattagctgggcatggtggtggatgcctgtaatcccagctactcgggaggctgaggcaggagaatcgcttgaacccagaaggcattgcagtgagccaagatcgtgccattgcactccagcctgggcaacaagagcaaaaaaccccatctcaaaaaaaaaaaccaaaaaaaaaaaaaagaaataagagcaggttgaataggcaaaacagctagcctgactcggtactggctcctaacccgcatatcttttaagtcctccctgaccaggaaaaggatccttgtagaaccgaagtggatctgaacttacaaagaccaagtagattaaatagagaataaaaggagataagaacaaggtgaaaagcagggatcaagattatgtggatggaatttcattgacattgggatatagctaaaactcacactcaccatagaaggataaaaggataaaacttgtcattttttaatataaagcatccggcaacatgtaacattgtcttttaagatgttgtaaggaaataccatattgcataaatgaagagcatgtatatctagaaagtgaattttgtgaaattccttttcagcaatcattccggccaagattccttggtgtggctgaacaattacacaatgaaggtttcaaggtatgttcattagttttaagttgttttctgtcagcatggaatctgtccacaaatcaaaatattgcagaatattggaaaagaaatagcccaaaatatgtccttttgatatgaaaggtttaactaacttggtagtttcaaaacttagagtcaaatcattaaaaagactggtattaacttttaacaaaattaccacaaattcaatagaagttgccagctaaaaactgagaaagtttagcttaagcacaattgagacaaagtcccaacacatttccatatgtttttcctttttttgttttcatatgaggttatagattctagctgtgacagttacaggcaaaacttctttgcagtgaatacctccacacaaagcctggttgagtaaaacaaaattattcccaaggcttatgatgggcctgtggccatggggattttttgacctgctaacaaggaattagccatgaataattgagaaattattaaatttatgagaaattgtcattgaattattaaattcaaattaaacatataattattaaaatggaaatgcaaataaaattgaggttcttaagttttttaaatcactgcaaatatataaaaaatgtttaaagtgcccatgcctctggactgtgagtccaagtctctatccatggcactatactacttctcatgttcagcaatttcttcttctttatgttttaaattacatgttccataaaaataagaaatcactgtgatacggtaattgattttttcattttaaatgcagctgtttgccacggaagccacatcagactggctcaacgccaacaatgtccctgccaccccagtggcatggccgtctcaagaaggacagaatcccagcctctcttccatcagaaagtaagaactaggcatactgttttctgaaataatttagaggattaactttgagaaccagtatatgaatatttcaccttacttgattgcaagtcttttaaaacaaatttaaaaatgaatacatttgtggatgattgtcaagtttcactctccatcactatggaatacataacgtcatgtgtacatggtgatatgaaacgtgtttcaaaatacttcttagtaaggatactttccttgacggaaacaagtgagagcatgaagaatgtaatgcagcactttatatttcatgtcaaacttatattgtgtatagataagtacatcgagtataagatgaccagctatatttcactaaggttgtgcataataaatcaatttgttgagcacttactacatacaggaacctatgttgagtactatgatgatgtcatccattggattacctaattggtcattccttgaccaggttttcatgccttagaccatgtcatcattagattttgtacgacattttatttcagcagattgtgtgaatcttcaggaataccattgcatcaacccttaaagatctatgtggcataagtacataggagataattctctgctgttttaagatagtgcagcctacagaatggctgtgccattctatgcaatatgttatttgttagcgttcttgagaaaccaacacataaattattatcactttaataaaataatggcattgtgttcaaaccttagcaggcctccaaggatgtaatagctccgtgtttggggcattgtaaaacaataattagcactactaaggaggcaatagagttaatgtgggagtgggaacatgggggtgaaagggcattcaatggtggagggatcacctctttttaaaaaataagtatctatcaaattaccaattcttaatgagtgaacagatagcattttaaagagaaaacaaacatctgcattccattagacttgcactagaattccttcaagaacacaatataatccctatataagtgtaatttaaacatctacttagcaatagaggagggcagatggcagtcaactcagcatggcattgacttgaatggctaagagagcaatttatgttagtattttataaactaactataaaatatgccttgttgtctataagtttttgtttatttttccagattgattagagatggcagcattgacctagtgattaaccttcccaacaacaacactaaatttgtccatgataattatgtgattcggaggacagctgttgatagtggaatccctctcctcactaattttcaggtatagtcttttccttggatatagactggatgggagttttatttctgtgcctcccttaagagtgtaatcagtagatgcacatctctcttttcccctctttgtaactttcagaatagagaggaatttttaataatctaaaataatgatgctaacatggtaggtcatggcttaaatgggacagttggtgatcaagcaattgagataatcaaaggccatgaatggccatggctctctccttacaattatcctttgaataaaaagtgacagcatgacatggaataaagatacaaacttttatttcattgtttctaaatgaaagccaccatataaaagcaacaggttaatgatggtccagatgtagcacaagtgcttgttcaattcacagaaaatgattgcatgaggcatgttcagtttcacttggacatgacccatcgaatttatcacagggagaaacagagtggagactcattaactttctgcctatcatatttattttttatgcagaatcagttttaatccctatgggaggagaaataagcgtattcacagtgacatctgagatataaaagaaagtccccatggtgaggtctgagacatgggagaaagtctccattacataaaaaacttttatgccttttatcccatacccctttgaaaactggggacagacacttgtgacttttgtcttcattcattaaaaattcacttttatctcatggagggtgctgattcctaccattatattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaagaggtaa

SEQ ID NO: 2 - DNA, 68906 bp, Homo sapiens
aggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaataatgccttctcttattttattttgggaggaaatgtgatttttatttcttaaacagctcaaatattcaattgaaattgtttcacttctcttatttcaagtataaggtaaaaaaagcccagaatgactgtggggtttaccaattagtgccagagttagatcagataacaacctggagaaaagtttaaagaactaggttcaaggcctagcaccacccttgctggctatatgaccttgaacaagtcactaaacttttctgcaatgttgtttcacctataaaatggaaaaaaggataatacctgttctgcctacattacagggtggttcaatcattccttcaacaaatattaattgaacatctactttgtgccatgccctatcaaggagttggagatacggtggtaaataacgtaaaaatatacttcactccagctacatgaattcatagtctagtgataatcagtgagataatgtatatgaaacctaaaaagtgacagaccaatgttcattatttattttagtattccattacactgagttacatcagataaaaatgtgatgaaattttattctatagcttttaacaaggaatcatcactgagttgaaaacacccaactgaatgaataatcaaagcctggaacttaaacttatactgttctttgaaaactacaatgataattgatttttaaaataattattacggattaaattttgcaagtaaaacctcctccaaacagttgaactttttttttttgtatttactaatacactactgtctatatccagtagccagactacatttctgaaaatcctggtgagctatttctcacagtgaatgggggctggcacaaaagtatggctaaatcggcccaaatccaaactttctatttgaaagtgtgaaagcctcgagtcacccatgttgttagaaactcaatagtgtgaatctctattgaaaaatgagataatgttgaaatggtttcgacatgcattctcacgtggcataggtatttttctttcctactgtattggttagttgcactacctgtcagctagataaattcagaatttctggtctccaataagacttacaacctttgacaaagccctcaacaacagagaaaaactccctgtcaactctgcctgttctatatttttgctttgattttcagcctttcacagggattcgagttatttttttctcccacatctcttgggaaaggtggagggcccttgttatgtaacataccacgtgagtttactactccagaataataggaaatatgtggttagaatttgatggtgccacaaaataggaatcgcagttttgaagtgagcggtcatatcgccatggacatgataaaataatagcttaagtgaggctgaagccatccacacagcccctggatcaatcacttttagtcagttaaatttttttttaacaagatcgataggatcagaaaccaagactgctgaaaacacccaattcacaggctttccatgtcataaacaaggctctaaagccttgctgtgtttggataatagagaatatcctatgatttgttgcctattagggaaaccacttaaagctttttaagaaaccactaaaaaaaaaatctctttctttatcagaaaagaccaatttgtaagtgcagttcaatttcatctcacaaatagaaatttcttcagagaatattgagctaagctactcaattctgtggaggttatggattggagccagaggtgactagttttcaggtgtttcattccagacctctgtaagggctcacataactcattatgctcccttcgtctctcacacatgcccatccatacacacgtggacatccagacaacgtgattataagacgttcatgttcttgcatagaggagagaaaccagtgcactttgattattcacaatgtcgaaacttaaaatgaatgccttttaaaaacatcacttcagctgggtgcagtggctcatgcttgtaatccctgcactttgggaggccgaggtgggtggatcacctgaggtcaggagttccagaccagtttggccagcatggcaaaaccctgtccctgttaaaaatacaaaaaaagaaaaagaattagctgggcctggtggcatgcacctgtagtcccagctactcaggaggctgaggcagaagaattgcttgaacctgggaggcggaggttgcagtgagccgagatcgcgccaatgcactccagccacctgggtgacagagcgagactctgtctcaaaaaaaaaaaaaaaaaaaaaaaaatcacttcacttcagaaaaccatacaagagatgggaccaaaagttgaatggggtcatgatgttttccttggccaacagtggaatttgtttcctagtttatttttagtaattgagtaacgtaacttagataaaataagccactgatttttgagtttcaggtttccagatctttaatagtaggtctgcagaaagctagccttcatctgaattcttcaattttcagatgagaagtttcacaattttagaatattaatgatctaaggtatcttagaaactactagtcactcagtgctcaataataatgttgtagaaaaaactgagttcttttcacatgaccaggaaagtttaggctcacagacactttgaagggtgagggggagcggaatttattgagtgaaaaggaaaaaaactcagcaaagccagaggggttcctgttaacaggcccccatctcacagactgaatgccaggttaccacacaggaacaggagaggcctagctcctccccactccaaaaggtgcagtgcgaacttccccaaggccccaccctgtcctcccagtgtgcaggtgggcattattcagaaagaatcagtcaggggagtgtggggaaagggcgggcctcatccgggacaggcagtcctgttcatcagcctacaggctgttttaggcttgaacgtggggtttcgctgggggtcgcgggtttgggggcccttggctgccccttgtctctatcaataatttatatcacatatgggtatgtggcaacagtgaggagggtttcaagtaaacttttattaatacattattattgttattgttaataagcataaatttggaaaacatttgtgagtttttttcacatcagtgggatcactgcaaagtttttttttgtgaaaatacagctcctttcttttgcatgcattctaatatgcctttttgagaaggaaagaaagggatagaattaaagttaggccactgaaaattcatgtggctccagtttacaaacttcatgagtgtgggggaagacatagacaaagagaatcgctaatttcgttcactttattaaattttcaggtgaagaattgaggctcgagatggcaaataaccttcccaaggccattgtttattcttaaatctgggctgaactaggactacaattcaaatatttaaaggcactgctcttctcatttcattgcttgtattactttgatcccttccaattgatcaagctggccaatctacctttgcctaatatccttttttaggtacagccagaatatctcagtaaagaaaaaaaacatacacaagaaaatatgccttagctcttgcattaatgcaaggttaaagaaacataaaaatctcagccataaggcccattggccccctcttatgtctccagaagttaaagtctttatctcaaattgtccatggggatcagagtatcatttaacactgaattttttcctactctggcaaaatcagtttctgactgaccacattttactcaaatcaagcactttctcttccaataaaatacaattataccaggaatacatccaagtctctcccaccccccagtttaccagagttggaaaatgcagacactagcaatgaaaggcttcattctgcaagtagcaaatactcttccattttgtagctaggaagatatttgggtaaagttaatacaaggatctcttattaccttggcttagcttcttagcattcagtgatttggggttaagaaatctctgtaattattttttcaaggaataaaatgaatataaggaactagacttgcctttttcaagggctctggctctgaccagactgcagtgacagttttgatggagtatttgtacgtgcttctcattgtttcccacaacattgtatcctccctcttatgtgcagcctgaataataataatgtggtttgtgtctggtgtaccaaggagatttcttgtttactctgatttacttcttgtacactttggtacaagaaaagcaagcattttacaggagactcgaataatgcatttggccctggttctggtgcttgtgaaccagagcaggctgcctcctattgaagaatgaggtctctagggggaacttaatagccattgatgccagcagtcttacctggctaattcaagcgtggctttatcacccaaaagcaagaaaatgcttgctacagaccagaaaaaaaaaaaggaggcctgtgtcagaactgttttaatgtggtacaattgtggaactcttctaatttttatgtagcttaggaaagaggtgtggcaactccattttggagccaaggggaggtctgtgaggagacagtaaacaggataggaatttaaactgggaccattgtatttgctttccttccagtgataaatttccctggttagttctcgatatctatgaaaaacagctctttttcccaagctaacatttcctgccccacctcctggatggaattgagaaaggtggtgactactctaatgatttttcagtggtataaacagcataaccccccctcactagctgtggtggaatttttttttttttttttttgagatgaagtcttgctctgtcacccaggctggagtgcaacggcgcgatctcagctcaccacaacctctgcttccagagttcaagtgattctcctgcctcagcctcccgagtagctgggattacagacgtctgccaccatgcccagctaatttttgcatttttagtagagatgaggtttcaccatgttggtcaggctggtctcaaactcctgacctcaggtgatccagctgcctcagcctcccaaaatgctgggattacaagcatgagccaccgcacccggccagctgtggtgcaattttaaaagaaattctagttaatcactcaagccctcagatgctggtatgaccagatatatagcatctacctctctaccgcttttgtccccaagaaccctgacaacttattctgtccaaaaggagtttgtggcaagaaagaaccaaagtatcagtgtagtccactattactgtacttccatttcagccttcatggtggtatgagcaaacattggccctataaggtatacttgccagttttccaggttttggcccttgactcatagtgctgtgcttaggatccaagattagtccactcttgtttcacatacatatgtccagtcattgttcccagtagtgcaaatactataccagagtggtggggttctaggggatttcagctttagcaacacactaggccacagtcaattatcctccatgattttcaggccttgtgttcagcctgggccataccctatatttgctcttccctcaacataaattttgtcttttttttttttttctgagatggagtttccctcttgttgcccaggctggagtgcaatggcaccatcttggctcactgcaacctctgcctcccaggttcaagtgattctcctgcctcagcctcccgaatagctgggattacaggccctcaccaccatgcccagctaattttttgtatttttagtagagacggggtttcatcatattggtcaggctggtctcgaactcctgacgtcaggtgatctgcccgcctcagcctcccaaagtgctgggattacaggcatgagccaccgcacccggctgaagtgatgttttttaaaaggcattcattttaagttttgacattgtgaataatcaaagtgcactgttttctctcctccgtgcctggcctatgtcttttcttatcatcagaacttggtcaggatgttgaaaatccatcatgacaaatctttcaatattcatcccagaaatctgctgggaattaattctttctttcttttttttttttttgtttttgaggcagagtttcgctcttgtcacccaggctagagtgcaatggtgcgatctcagcttactgcaacctctgcctcccgggtttcagcgattctcctgccccagcctcccaaggagtagctgggattacaggtgcctgccaccacgcccggctaatttttatatttttagtagagacggggtttcaccatgttggccaggctggtctagaactcctgacctcaagtgatccgcccgcctcgtcctcccaaagtgctgggattacaggtgtgagccactatgccgtgcctgaattctttcttatacaaattgatttacttttgccctaatgacctactatcatttattcatttacttaagaaatatttattgaatgactactacattccaagcactgtactaagcaccgggtatatattagtgaataaaataggaaaggtccctgctatttgtggatcatatgtaatccagtgagaagagtaaaagtagcaataaataaacacataaatatatattaaaattgtgataattattacaaacaaaatgaaggtaaagtgaagactacttagacagtagagtcaggaaaggaatctcttaggaagtgatatttaagcttacagcctgagaatgagaaggagccagctttgagagttgaggggagagtgttctggacaaagggaatggtatatccgagtcctgtgatgggaaagcttttggagtacaggcagcccctcctttgcgatatcccaatgtgcacaaatttcaattaccacagtttagttaataacactaggccactacgaacacagttcaaatttcagtcaacatggcatattaattatgagtaattcataaagcaaaacttcattgctaactcttcagtctacaaatcaccatgtaaataacacatacacagtacctcatggtcagtgaccaattacatcacttctttcaaagtctgttggtgattggtcactgtgcatctgtcattcagtttgcatacagacagcaaagagtatatagctgtgctgcctccttttctcccagtgataaacccatgggcattttacaaaaatggataatgacagtgcagtacatgaaagtgcagcagagaaataaaaagtgcctttgggaggctgaggcgggtggatcacctgaggtcaggagttcaagaccagcctggtcaacatggtgaaactccatttctactaaaaaacacaaaaattagccaggcgtggtggcagacgcttgtaatcccagctactcaggaggcttaggcaggagaatcgcttgaacctgggagacagatgttgcagtgagctgagattgcgccgctgcgctccagcctgggcgacagagcgagactccgttaaaaaaaaaaaatactgatagcagtggaagttaaatttggattgaatgtaaatcgagttatggaagaaacagctgactatgtgattgttaccctgctgctgtttgagaggctgtagatatacagccagaggaacttagtgaagacaaagttattgacataactgcagaaagtggttgtgacaaaaaggatgaagatgtcccaggggaagtaacaccagcaaaacacttcacattaaaggaactctcacagatattacacagcgttcaaagtgcaaaggaaaatgttgaaagtttatccaaacttagaaagaattatgacagtttaccaaaacatagaaaagatgcttgctctatatcataggttctaagatgagaaagcaagcactgttcaaattactcttgatagagtttttacaaggaaataaagcactataattctcaatgcttctaatgttttaaattacattgtactaaaaaatacatcagttttactatttttcacttccctacacatttacaactgacaataaaagtttttaatgttctgacaattttttaaaagtcacagaacgattacaattttcccactaaatattaaggttactttacatggcttcagatttaatggctattcacagtcccacacactaccatgcaaattaaaaactgcctgtgtttaaaaaaaaaacagttttggaggacattatgctaagtgacataagccatgaaggacaaatactatatgatttcacttatataagaatcaaaaatagccaaactcatagattctaatttaaaacatcagacaatactggttgtcagaagttgggagtgggggaaaaggggagtttttctatggatctaaactttcgattattctagatgaataaattctagagatctgctgtgcaacatagtgcctatagttaacaatatggtgtcgtgcagttcaaaatttgttaggagactagatctcatgttaagtgatcttactgcaaaaccaaacagcaaacaaaaacacaaaggggcacaaggaaactctggggtgggggaaggttatctgctaacatttattggagatgtgattcaagggcagcaagagtgagggcagcattatcagctgctgccatggaaagtctagagtcagaaagggagatttttccaatcacttgtagtccaagggaaaaatattgaaataaagtttctgttctatatacatttgaaaatcaaaggccttgacaaaaaggaaagcttcaagcaggatgtttgtgtgttctttctacctttatattcaaatcttctgtcagtggagaaatagaaacagcagcatctcacaatgcaaacccacagcagaacattaaccctaaccctaactacaagcttaatttcacttccaacttagaaacttctaagtatgtaggacaaaagctgaggaagccccagaaacttgttactttctccagtctgtcttctattggggataataagaactggaagctggagcttttggagtagtaaaaggtaaggtattgttggtcctcctctttcctgtttccttttatggaaattggggagaaaaaatttagtcctttgcaaaattttcatttccacttctatttctctgagattcaacaagaacaacacaattctaagatctatgacattctcttaaataaagcctgtagccttgtgagcattcagaagtaagaggatacaacaaaatcccgcagaggctgagaataggggatgatattgaatcctttaagtatagcagtttggagactcagcttttgtgggctccaaaataaccaggagtctgagcttgaactcaagacaaaaaattgagggcctcaaaattagttcatgagtggtttttcctgtggttgatggatgtgagttcaacagctatagtgatgtttctcaaattccttgaaacagagggagtggggttttccagcaaagtattcttccccttttaaaataatattagaggaagtcttaagccaaggaatatcaatgtgttattgtaagacatgtagtcaagaaggtttatcttctgtaattttatgttgcttggatcttattccagaagaaaaatattttcaaatctgccccaactgtgaattgagaaagattaagctgccgtgccttcatttcaggccacatatgcaaatctgttttataatccccagaagaagatttcagttgaccctgaaaaatgcatgactgttagtcagtgcttactccttaacattatcagtacttagtattccaagtgttgcttaatattatcactaattaatattatcagaagaaaacacataaccaaaatttgtacgtaaatacaaattttctgtctaaatgccttgcttccaaagttatcaaattgctgactatgatggagatattgggcacagttgtgtaagcattttactaggatttcagtagaaggaagaaaatgaagggctgtctagaaactgctttagccagcaaaatgtctttgtatatctacaaacttatttttaaaatatttggttctttgccgggcgtggtggctcacgtgctgtaattccagcaggttgggaggctgaggtggttggatcacctcaggtcaggagttcaagaccagcctggccaacatggtgaaaccctgtctctaccaaaaatacaaaaattagctgggcgtggtggcacatgcctgtagtcccagctactcgggaggctgaggcaggaaaatgtcctgaaactgggaggcagaggttgcagtgagccgagatcacaccactgcactccagcctgggtgacagagtgaaactccatctgaaaaaataaataaataaataaatataataaaatatttggttcttcttagtctaaaccttttaaatttttattttcgtgtatgttttgttatgtacataatctattagtatagcagcacatataaacaaataaaacatacattatgaatccatgtttaaaagtttttactgttagaggtacgtaataaaaagttgaggaccactgctttaaagaaatttccatttggagagcccatgactcacatatttttaaaagtcaaagacaataatacatctttgaaatagcaatgttaactaaaattttgtttctacatataagctgaaaacagtaatttctatttgtagttgaatatgtcatcaatgtcttagattaaatcagtcaattggctgggtgcagtggctcacacctgtaatcccagcactttgggaggttgaggtgggcagatcacttgtgctcaggagttcgagatcagcatggccaacatgatgaaaccccgtctctactaaaaatacaaaaattagccaggtgtggtggcaggtgcctgtaatcccagctactcaggaggctgaggcacaagaattgcttcaacccaggaggtggaggctgcaatgagccgagatcacgtcactgtactccagcctgggcaacagagcaagactccatctcaaaaaaaaaaaaatcagtcaatcaaccaattagccaaccaactgacaaactcttaatccttatggaaattctcttccctactaactagacctctgaagggctcagtctcacaaaatgtctaccaaaaaatatctattcacccactgaacattaaatgaaccaatcaactctgcaagaaacatatgtagtgcaatattcacttgtctaagttactgacatcatgcagtggaaacaacaaattgagtgaatttgtgcttttcccacctataagcttatcaccattgcaaaaagacctccataaatcccaacagatgattaactcttcatcccaagtagcacaggctctcttgttaggttagaattaaagcatgatcattttgtgacagttattttacttctagtaaaattaatgtttagtacacgtggtgaaccacaatttgcctttggctgtttataatttcgaatggtagaaaataccaattattgttaaacacagataacactaggaatgatgagagaaagatgatgtccattttatagaatgattaccgcaaataacaattattgtcatcacaatataacaaaatgttaaaattgatctttttcggttttggtttctgtccaggcccagtaggtactgattcttccctcattctaaagagatgctagaccactaaaaatggaattgcaaaggaaatagacaaaattcagtttggaatcccttagttaccaccttcagcttataaaatgtgttgcagaaaccaagagaggggttggaaattagaagataatttatagagagtgtttctattgtgtatcatgtgcctcctcccccatgaaggggatactcttccttcacttcaagcccaacaaaatggctccactagggcccacagtaaactgatgtcaggatgatacctgagaaatttaaagtaggaaagacaggctagttagctgttctgatagcagaacaagatggagtctataccaggatggacctgacacttgttagagcaaagaacatggagaacttcccatgaagcaatagggaatgagataaaaaagacctagcatggtattgtttcagatcatgaccaagagacctcctggaggggtgggggaaatctcagcaaaatagaggctggatgtgttcccttggatgccagaggaaatgtaattgtctgtatcaaagactgctatgagaaattcctaatgataagcgggggttctccaaaggacctccaaaaacacatcacaagagagtcaggtgttggagacacgtgcaccaatgctagattgctagagcagaaccaggcttttgctggctcttaactcctcaccttcccttggcttcacttagaggaactgaaagtaaggaaacgaggaaatagcacattggcccctctttccccatagaggaggccagctttaatcaggcataagctggaagggaaaaggtgttaacctgcagcaaatttcttaaggtttttttaaaatcactattattattattatatttttgttacatgttattttactgagactctttgaggtagtaaaataagcagagggctttttgtatttttctgagttagtagaaaagttacagcgtccattgtattttcatccagggataaaaagaacaagctccaagaacagatttgaagggcagtagggggaaaatacgaaattattttctattgtgcattacaaatgctgcttgtacagcccaatgattttaataataatagctaaaagttatcaaatacttattatattccagacaatgtctgctttacatgtattaaataattttatgctcacaacaactctataagattattatagtaattttctaggtgtgaaatttagaagcagagagtgggtaaataaactgccctaggttgtgtgactagtaagtgacaaagccactcatgtggctatttcaagcaaataaaaattcaatctcttttcacaaattctttttttttctgtcaaacatccaaaatactggacatacaaaatataaaccaaggccatatcaaatttcaacgcattaacactttgcagagacacatgaggttatatgtgatttgctgtgctttatcaagaataagaagataaagcatttgctgtgctttatcaagaggccgaggcaggcggatcacttgagctcaggagttcgagaccagcctggtcaccatggagaaaccccgtctctagtaaaaatacaaaaattagccaggcttggtggcatgtgcttgtagtttcagctacttgggtggctgaagcaggagaatcgcttgaacctgggaggcagaggctgcagtgaactgagattgtgccacactccagcctgggccacagagtgagaacctgtctcaaaaaaaaaaaaaagaaaagaaaagaatgccttatcaacagtaaaacaatgaatcaccatagtacatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaaaaaagcataaaaatcagttattgaatgacaagtcattgcacttttttcacgtggaatgctgaaattcattattaactggatcgaacctaagaaatcatttgtctgaaaagcatttatttatttatttatttatttattgagatggagtcttgctctgttgcccaggctggagtgcattggcgtgatcttggctcactgcaacttctgcctcccaggttcaaggaattctcccgcctcagcctcccaagtagctgggattacaggtgcataccaccacacctggctaatttttgtatttttagtagagatggagttttaccatattggccaggctggtctcaaactcttgacctcaagtgatccgcccaccttggcatcccaaagtgctgggatcacaggagtgagccaccgtgcccggccaagattttatttttataccccttttcttttctctgtgtattttctatcaagtcaaaaatgaaggccaggcgcagtggctcatgcctgtaatcccagcacttagggaggccaggcaggcaaatcacctgaggtcgggagttcgagaccagcccgaccaacatgaagaaaccccgtctctactaaaaataaaaaattagccgggcatggtggcacatgcctgcaattccagctactagggaggctgaggcaggagaattgcttgaacccaggaggcggaggttgcagtgagccaagatcgtgccattgctgtccagcctgggcaataagagtgaaactccatctgcaaaaaaagaagatgatcctttttttccaagtgacaaattttaattttggatgcatatcagatatagaatcattaggataatgtcaaaaaattcacaatgatgtgacagcgttttaaaaagcatttagattagcaaagaaacaattaatggtatccaggtaggagaagagatgggatatggttcttagctataagcataattctgcattttgagcaatttatcttcgaaagacaattaatacagtagcttcatttggactgcttaattgtgaaagcatttttgtattccaagcttgttcagcctttttaaagagttggtttcaggttgagaaagtttgacacggttttgattttatctagtaggctggctctccaagctcctaagaaaaactgaggacaggagtgaccgcaactgctatgggttgatgttcctataaaacacctgaaataagagaaaaggtctccccaggcccaggcctatgttcttgacactttgtggatgagggaggttagctggcaggaatctatttgttccagaattccttctatcaggaagcccatctacagaagaggaaggaggaagcgccccaccccacattcagactctccagattgttttcaaatgacttccagaagcaaagtctttgtattcccatgaggatgcatgatgaatgtgtagctaaaacactagggcttcatcattgatctaagtgaaagttgtagtgccccatgttgtaacagagtagcattttcccagctgagaaaacacctccaaaccaaacaccttcgaggtcattgaaaactgaatggggatttcaatagagttaagtaagaaggtggttccagtatgaaatactaatatattttggaaaaaattcacatgttgaacccagaacaattaatactgctttctaattacatgtcaataagctgtgggagttactgttctcttcccccatttgtatagtacataaaaaaacattttaaattcacttttttttttttgagatggaatattgctctgttgcccaggctggagtgcagtggcaagatcttggctcactgcaacctccatctcccaggttcaagcaattctcctgcctcagcctctctagtagctgggattataggcacccaccaccactccaggctaatttttttttttttttttggtattttgagtagagatggggttttgccatgttggccaggctggtctcgaactcctgacctcaggtgatccacctgccttggcctcccaaagtgctgggattaaggcatgaaccaccacacctggcctaaattcactttttaaacaatattttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgagatttccagttctcataaaagctgcaagcagaaaaattagcttcatctataagaattccataaggaactgagtagaagttccatataactcttcatgttcagaaaagaaatataggtgggcacacattttcaggccttgaactcacgtgggtaagaaatatgtctatttttctagcatgcaaagaacatttccttgtgtgtctcaattctgctagatggtggaaatttaatctttgcgatgttaggcaatcctcagttgttttatggtttattttgtccattttgggtctcctctccatttccccacagtcaggttaaatcatggagagtatctgaatgtcaagacatgtaggggtatggggatctggtccttggtcattagaacatcatcatcaaatatccatgctaggttctgttgggacttctatattcccattggatcttggctgtctcccacttactgcaaggtttgcttcactctcattgaaagaactcatattgagacaaccaagtataaaggggtcactggagaacctccaaccggcctgaacattgggaggaatgcacacggggctgaagcctcaggaagttcacaccatttgcgcggggaagagctggcctctcctgttccgaggtggaaactgggattcaatctgagaggcgggaagacaactagcaggactcttgctctgctgagagtccctgttttccttttttttcttttcacccgataaaccctgctcttctcacccttcaaagtgtctgtgagcctaatatttcacggttttgtgacaaggaccccattacaacaatatatctcttggtttcattctctcaacctcttagcagctctccaagacacattaggcacagaggtactacaaggctgcctctactctattgttccttcctcatgctgggtgccatggagctctataacatttactgccttctagaggtctgtcttaaaagcaagacaggttgtcctcagttctgggattctccaaactcatggagctttccagcatgcccccccatccttcagaagttgacttggggaacacatagcagagtacagtatcaaaggtccatcagtttttatttctgttgcttctcctctcttgcttctcttcttcccctttcagttcccagtattggaggccaggaaataaagcaggaggaaaaactggctctgactatccatggactcttccaaattgtgcctggaattctaggctgttaaggatattttttttcctcaagctattatctctgcagtttcaaaatggacactttgaaactcgtaagccacaaattgcctcttttctttctctctgcatttctgctctaccagacctcacttgaatcaataatatgactgcccaaatgagcaatcagacagggtcaaggaggaagtaccgcaaacaaaaacatattggttgatatttcaaatagattattctaccttacgagtgtcagagctttctagggcttagaagcaaacaactattacatgtgatttttaccttgcaatgattaataatgaagcttaccaaatagatatcaaaaagaaagttcagggggattaagcgacttgccaaattcactcaattaatacagatagcaccaagattcagatctgaagcccactattcttactaatgcacactccttccccctaaagagaaggaaggaggacgagggaaatatataaggtgctaatctttaaagccctaggaagaaaacagataagaacattttgctctttaaagctggctgctgtaagagatcatgttgatatctgacagatggtagggaaaaaatgaataaaccagtcagcaattctcaaattctgctccctttcaacactagtattccatgagttgggtagaattttattttatttcattttatcttgtgtgtatatatttttgtttttaccgttagtacttaagagaattgttcttttttgaagtcaccaaaataattgtttaatacatagaaatttctcaaatttaagtttttttaaaagggattttgctgagttcatggcatttctatgacttttccctgttcaaatgttatgtttgaaaccagaatatttctgaataaatgattggtttcaccatttataataatgtggtagttaatctattaataaaaatgagagtgacaatttaataagtttttggaggcagaccctgtgccaggtgttctacattaattatgtgtgttatctcactcaatcctcatggcaactctgtgagagcaagaccattcaggaaaacaggctgaaatggggccagcaaatggctcaaaggcacgtacctaataaatggcagacccaggattggaagctattactatatatatttttaaatacctaatttaataaactaaatctattgatttaatttaattatatggcatgtaatagtcatgttttcttctagtaaaattgtttctactggtggcattaagcattttgttaaatgatggttttctataaagaaatccttagaaacctgccccaaatcgtaaataataacaacaaataaatgaagcaaggagagtatgactgttaaaacttatagttcatggagcatttgtcattatcctcaataattgcatatggcatcctgccaaactcaacagtagaatcactgaaagcgagtagctgtcttaattgtttacagaaacagtaaaccccaatcaaaatcatgacagaacattcctattgtgagtatgtgcatcttaacagttgtcctttggtacaatttttcaacaagtaccacctgttactttggtgcttagaattaaaataggtgtaattataactgttactgccccaaatctgtgccagcccctgacatgatcctcacaggacagtccttggcaattctgttccaagcctgagtttcagagctacgttcacattcctacttatctcaggagacagaatcaaattctccacccaactctgaccatagtaattgtttatgtaacatgtttattaaagtgtaacacacaaacagaaaagtgcacaaatcattaagcgtatagatcgatgaattcttacagtgagcaaaccattgtaactaacacccagatagagaaacagaatggtagtagcacccagaagcttcccactacccttcatttccttccagtcactactcctcattcacccaagggtaactattatcctggcttctaacatcacagattcattttgcctatttttgaactttatattaatgggatcattcagcatgcgctcttttgtgtctgacttcgttcgcttaacattatgagatgtatcgatgtagctgtgtgtagttgtagatcattcatgcctcatccactctttgtgtgtgcctgcctggcaaaccagacaattctcctatgagtctaccaatgataatattcttttatagcaaatgaattgagctgatagacagatacatttattaatctcagtaaatgcagtagctgataaaagatgcaaaaggcattctaagagatggttcttttcattatttaacattggtatttcactttcaaggtgaaatagaaactggtgttttaacggctgtttcaaaatcatcgtctgtacaaagatgccaatgtaaaaattgtgatactattgtgcaattataaaagccaagcacagagaggttaataactgccttagttctaccagcaaaggtactcggatcccttatatttccaaggaatgaattctatttatactctttttaccaaagcaggcagggatctatggggaagtaaaagagcaaaataagatttacttttattttcccaaacagaaattaagaaattagcagaagaggccgggcacggtggctcatgcctgtaatcccagcactttgggagtccgaggcaggtggatcacgaggtcaggatgtcgagaccatcctggctaacacagtgaaaccccatctctactaaaaatacaaaaaattagccagacgtggtggcgggcgcctgtagtcccagccaatcgggaggctgaggcaggagaatggcgtgaacccgggaggcggagcttgcagtgagccgagaacgcgccactgcttccagcctgggctacagagcaagactccatctcaaaaaaaagaaaaaaagataaaaagaagaagaaattaacagaagaaacgctatgttcaaaaatagctgatgtgaaagcataaacaaatgaaacaggtaaaagcaggcttctctggataaagggtggagaaagagtggaagcccatctctctgtcctcttctccttggcaatggcagcttctagtggctgctcaaaacctctgatgcccctcataagcacgtattaccatccagacctggtaaaccggcaaattcttgacttgtgcttttgggctgggatctgaggcttctttttgatctgtgacaaaaattgcaaaggcaatttcttctcagaggtagtatttcctccccatttaatctttttcatgaactgctgaagtctttggctcctgcctgtacacactttctgttactcttcttcctacccctatttcataagtccaagcaccgtatcgatcttctgtatagcacaaacagggaagtagaaggacagcagattaatcctgagttgctatagcaaaatgacttatcatcaaagaaagagtgtgacttggaatagacctaccaggaggtccgaaactttgtttgaagtcttcatccatagtcctcaaccctcaatggtactcatacttgtactaggcacttagtaggtgcacaataaataattttttgacgaatgtgcggtatttatgtgtatttaggtgacgttgcatgtttataaagaaattaagtactcaagagtgattagtgattataatcaccactaaacttcattacgttgcttcatagataatagaaatttctcttctttctgttagcaaaatgagaggctgttcacaaatgagaagaatgggtcctttcttcagagtcaaattcctcctttattcattcaatgagaattcattaagcacttactatttgccaggttttattctaggtgctcgggagtgatacctcagtagacaaaacagatgaaaatccatgccttcatggggcttacattctagtgggtacacagacaataaacaacagacataataaataagtggatgatacagtatgttggaagatgataagtactctcagcaaggagaagaatgtgtctggaactgagggaaaaacaagtgcaccaatattgggactttggctttttggggaatcgttggatgatcttgaacaaaggagggacatgatctacttgcattttaaaaggatccctctgactgagaataaactgtggaatagactgtggggagcccagggtgaaagcaaggtagaagtagtgaagcctgtcaatagatagctatcaattatagaagctggggttgtggtggcagcagtggagagggtaagagtaacagatcctaggtatgttttgaagagagagacaacaagattactgatgtattgggtaagagagagatgtcaaggatgactttaagatttctgcctgagcaaatgtgaaggctggtgatggaacaaatggaaaggggaaggttgggaattcggtcttagatatattgagtttgaagtgtctattagacatataagcaaagatgttaaaaaaaagcagttgcacatgagtctggaatttgggagtgaaatctggcctagagatatttgagtgtcaccagcatatagatgatatttaaggccatgggactggatacaattataaagagagtaagtgtagattgaaggatgagaggagaaccaagggctagtcctggggcacaccaacattcagaagtcaagaaaaatagaaggaaccaacaatggtgactgagaaggagcaactaccaaggtagatgcaaaggcaaacaggtgtgatgtcctagacactgtgtgaagaaagcttatcaagtagaaaatgaagatcaactttgttgaatactgctaagtgaaggaagagggctcagaaatggccactagatggagtaacgtgaaggtcactgataactttggtgagaggagttttggtgcagcagtggtaggggacaaagccttataggtttgatggaaatgagaagagaggaactagaaaaagaaagaagaacaaagagctttgctgcaaaggggagcaaacaattaaaggaatacttgtcagggaaattaggacaaagagaaatctgtatctgtttttaaataatgtgtgaaaaatgagaacaacccattcaagatgttggtgacataagggagaaagggaggaattgctagagcaatgtctttgagtaggcaaggggagtggcttctagtgcacgagtgaaggcattacatggggcatggaaaattcatctatgcttaatagaaaggaaagcagagtatatgagtacagatgctgactagtcgggaaatggagtagagtctggaagttctcctcttattcctgtaattttttcagtgaggtagaaagcaaggtgaacagttgagaagctcacttcacctctaaagacatgcatccactgataatgaagggatggcaaaagatattccatgcaaatggaaactacaaaagagcaggagtagctatacttatatcaggtaaaatagatttcaagacaaaaactggataaaaagacaaggccattatgtaatgataaaggggccaattcagcaagagaatataacaacaataaatatatatgaacccaatgctagagcacccagatatataaagcaagtattactagagctaaaaagttaaatagaacctaatgcaataatagctgaggacttcaacgctccaccttcagcattggacaaataatccagactgaaaatcaacaaagaaacattagacttaatctgcactgtagaccaagtggacataatagatatttacagaacatttcacccaacaggtgcagagtacacattcttttccttagcacatggaacattatcaaggatacaaaacaagtaccccaaatttaaaaatacttatattaaatatattttctgaccacaatggaataaaactagaaatcaataacaagaagaattttggaaaaaatataaacgcgtggaaatttaaaaatgtgctcctgaatgaccattaagtcactgacaaaattaagaagaaaatttaaatagttcttgaaacaaatgaaaatggaagcacagcatattaaaacttgtgggatacagcaaaagcagtactaagagggacatgtacatcaataaatgcctacatcaaaaaaatagaaaaacttcaaataacctaatgatgcatcttaaagaactggaaaagcaagagcaaaccaaacccaaaatttgtagaagaaaagaaataatacagatcaaaacagaaatatacaaaacagagactaaaaaaaataaaagatcaatgaaataaaaagttggttttttgaaaagatacactttcaaaacataggaagaagccaaccattttctcaacacgttagctgctaccaccttgttccagcctatcaactctcacccagattttcgcaacagtctcctgacttgtctccctgcttttgccctgctacagatgtccaattaaaatgtaagtcaaatcatgtccctcctctgctccaagccttaaaaggcttcccattttatccagacaaaagtcaaagttgttgccttctccccagcttccttctgcagcctcacctctgcaccgtccacactaccttcttgttgtctctctctctctctttcttttttttagacgaagtctcactctctcgccctggctgcagtgcagtggtgcagcttggctcactgcaaccttcacctcccgagttcaagtgatcctcctgcctcagcctcccgagtagctgggattacaggcgcccgccaccatgccaggctaatttttgtatttttagtagagatgggtttccccatgttggccagactggtcacaaactcctgacctcaggtgatccgcccaccttggcctcccaaagtgctaggattacaggcgtgagccaccgcacccggcctcttgttgtctcttgaacccaccaatcatgaccttcacacaggaactttgcacatgctcttcccactatctcgtatgttttctatggttcacctatccatcttcctcaggtctttactcaaaagtcccacaatcattgtggcttccttgaccatactacttaaaattgcaacttgggtcctgtaaatttcctattctccttccctgctctgtatttcttatagcacttatcagtatctaacatacaatatatttaatttactcattcagtttgtactctgtctctccccatttgaaagacaaaaactggaaaaaaaagacaaggccattatgtaatgataaaggggccaattcagcaagagaatataacaacaataaatatatatgaacccaatgctagagcaaccagatatataaagcaagtattattagagctaataagtagtcaaagacttgtatcttgtttacaatgctttcttcagtgcctagaacagcaccaggcacatattttcagaatgaatgaatttcagaatcatacagtgaggccaggacttgttgtgttgtgtagttactccacagacatgagatgtgccatccacctaaaatttggtttggttgctgacagtgagaatatctcacatgcaccaggaagatatgaaaaagtttattactcacatcatgtggctttctggggatagtaggtctggtttccaagcaggtctgaaagtagccccagagagcagagaaacgatatggagttctagtgtgatttggcgatggggctgggatgaggattcccatgcgcaaggtagggcttgtgcagtttgaacctcctgctagtgccaaaggagtgagcacctgaactttcttatcagctttcccagatgtagggctgaagggtcaggcagggagaggtggacagtcaaacatcagaaatggggtcagaatgttcattacaggtcccatagcaagtaggactgtttgggcatttcatattctttgatcctacctggcacctagcacataagatttgcaagggatcttacaactctaggcaaactgtcttctttttcagatgaagaagactgagtccagtcccactatgtcattctgtctctgtagatcacactttgagctgactcaatagctggcttccctatggcaaggcctagggctgtggagacttaaaaacaatcttgcgcaattttttagactctgactctcagaacccttttctataaaattcttgtaatatctactgtacactttgtcagactaagggattcaatgaaagaatgttaataatgtgccatcatatgattatgctctgtgaagagtcattgctagggtcagaacatggtggtctctagttaaagaccatttggtctaggcatatttaagagaacacttttgagtataaaataggtagactataattatttaattttatatacagtaacagaaatgaggaccattgctttgtgtgggtttgatttttaatatttttttttctttttggagatggagtcttgctctgtcacccagggtggagtgcagtggcgcgatctcactgcaagctctgcctcccaggttcatgccatcctcctgcctcagcctcccgagtagctgggactacaggcgcccaccaccacgcctggctaattttttgtatttttagtagagatgggatttcaccatgttagccaggatggtctcgatttcctgacctcgtgatccacctgcctctgatttttactttttatagtgaaactttcaaataaacagaaaagtaaaaagattagcataatgagcataccaataccctttacatcagtctaacaattgttaatatgttgccttcttcgtctacttgttttggttgttgaactaaagtaaattaaagttacaatgatattttaccccaaaatacatcagtttgtatccccaaaaaataaggatattgtcctatatggctatgatgtcatgatcacactgaacaaaaataatgattccttaatatcatttaatatcagtccatattcaaactgtgttaaggcttcagtaggatgtttcatgagattttgagtcaaattctcctttgtggatctgaaactcctcattccccaattcaccgtgcaattaatgatttcttccctgtttatgggaaacagatgggattagcaaattgtgactgttgcttatttcccaaaagataaatcaggcacatcataataaggaggggaaaagtaatgtttgtaaaattccttggacaaatctctatcttgcaattatgtgtatttgcctttatgtattggagaaattctgagcattaaaccagtctcaaatgagacagtaaagttctgattggatgtcaccatctcccataattttccccagaatgtgtgatgaaagggctccagcctgggtgacagggaagactgtgtcaaaaaataaataaataaaaatgaaaggcttgaaaataaaagaaagtaagcattgagatagtggtttcaagtcactaagagtaaaaaaagtaaaagggccactttactgttttccttatcttccaatcaagacagcgtcatatattttattttattttttatttttttcagacagagtcttgctctgttgctcaggctggagtgcagtggcatgatctcggctcactacaacccctgcctcccagattcaagcgattctcctgcctcagcctcccgactagctgggattacaggcgcctgccaccacgtccggctaatttttgtatttttagtagagacagggttttgccatgttggccaggctggtcttgaacttctgacctcaggagatccacctgcctcagcctcccaaagtgctgggattataggtatgagccactgcacacagccagctttatatattttagagaaccaaaaccaggcatagccccaaagagggaatgatgcctcgttattgccaggtcttgaataagagggtggagaaatgggcacacatgtgaaggagagttaattacttgagcacaaaattttatctacttccctcaattcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcggttgaaataatttttcttggcaattttttgaagaagcttctgatcataaaatttcaaacttatggaaattttgagttcatcaagtatgactcttagatttaacagttgaggaggaaatgaaggtccagggaaactgacattcagtggctcataactagttactatcagactaggtaataatattaataactactaataacacttattgagcatttattgtgtgctaggtatttttctgacttgtttaatccttataacaacccagattgtcataaagaagtgaaacaacttaattaggcacagactagctgctataacacaaaatctcaaatgtcaatatgctaacatagtgcagatgttcctgattggtaaaagggaagaacaggttattaatttatgtgggttattcagggacactggctgagagtgattctaccatcttcaacatgtgacctccaaggtcagtttgggtgttaacatccagccaggaccaaggagaatagagcatggagaaggcatacttgtttcaaagccaccttagcagggaagcagtacaaacaattccacttatatttcattaggaagtactagtagctcactcccatctagatgaagggagagacggggaaaggctcttccccactatattataatgaaactgaagcataggcctcctgactcctcatgcaatgctcataccactacatcatgtctggctaaaaaatccagagcaaatgtctttgttaaaagttttgccctcaaaagagaagactaatgattcttttcctgaaaatgatacgccatgaagttatttcttgcagataacgtctgctttttatggcaaccaccctagtataaagaattcacctcatttgacttgctgaagagatttcaaataactcttctttaaaccttttagttatgttatttcagatgggacaatgaaagtattaagaagtgtgattagcttctggattctagggacaaaaggaatcaaggaacataaattttttcttccaaataatctgcctctgacttggattatatttgtctgataattctgcttccacaaaagtgaaaatatactttattcaaaagcaaatattacaagctgatcaagggatgaagccagagacatacccaagcaaagtttcagtgaggatcctctatataggaccaggtgaaagatggtgaatgagtcatatgtaaagcactggttggaagagggttcagtgggaggaacagctgagcatccaaaaaaggagttgagcagtgcaggttggcagtcagaaagaggtcaggatccagaaatcagtgcagtgggcaggatcccaagatcaagagacaaacagccaagcatgggctgaaaattgaggatgggtataaacgtgctcttttctgggcttgctctccacacaattctcactgcaagtccttagttagaggagctctacatagatgctgagcaaaacagtctgcttacagttttttttttttgttacaagttccaaaatgattgggacattttgagtccatataattattatagttccattgctacatgaatacatgggtccatgaaatggagtccatataattcattttgaccattttgtcttatccaaaacactgaaaataatagctactccttaaagattgtctgccgtggacctcttgtgctattatctctaaatcttttttaaaatcttgcaaagtaagtattattggcctggttttatagatgaggaaagcatggctcagagaagttaatggagcttagaagctgactaagtcagggtttaaatcaagctgtctttattttctaaggccgtgttgttttgattaccccataatgctgcttctattcagcccacgagaggggcagcgaaacaagttatagaaaatattgggctgggcgtggtggctcatgcctataatcccagcactttgggaggccgaggcgggtggatcacctgagtttgggagtttgagaccagcctgaccaacatggagaaaccccgtctctactaaaaatacaaaaattagccgggcgtggtggcgcatgcctgtaatcccagctactcaggaggctgaggcaggagagttgcttaaactcgggaggcggaggttgcagtgagccgagatagcgccattgcactccagcctgggcaagaagagcaaaactccatctcaaaagaaaagaaaagacaaaaaaaaaaaaaagaaaagaaaacattgacaacattgacttgcacgtcaagaggtccccaggacaacccagaggtttgatgattcactaggagggctcacaggactgagcatatagtcatactcatagttatgatttattacaatgaaagtataccaagcacaatcaatgaagggaaaaggcagaagcaggaaaatgaaaggagtttctgctttgtggagaaaatgacagattaggcactgaacatattgcattaaagtttgaacctctgagtgcaaatgttcacaagtcattggagataaagaccttgagtgaagttgagagctgaagaaatataaatataagctcggtggtaaaaattacctccatggtctcaatgtgggagaattgcagaaggctgtgccatgagaacaggtgcaattaaggagggggaggaggaaatcctcagggcacaaagagaacaagcatagtacaatatcagaagaggctggcatgggagatgggggatgtcagaaaaaggagtagagtagctattgtagaaatctgactttcttttgtgtacgtcattactgcttaatctgccaaaatatctgacaaacaagatatgctgggactcagaaattcaataaagctaaattgaagaagacaagataaatctaccaccttccacagatgcaattgaataggagatgtaaggaagcaaatcttaatgacatctaccttgctgatatgcaccttgtaaccctcagcaatcgcttcctttgctttttgtagaagtttaacattttaaggtgcaaagggattggaggatgattaaatgacattgctggccctttcaaatcaaaagaatcatgcatgcctgacactgattgacggtgttgcttcttcattgctggtccagctgctttgggggcctggtcgaataaaaagtgcctgcacattgttgaaagaagagcctgagggagaatatagtgagtgtagcaaccaaaagaaaaaaaaagaaagaaagaaaaccgggccagtctcttgaaagctgttaaatgcaatttccatagtgccacttatttgttcaaatgatttaattgttcatttattcagaaatagttattgaatgcctcatttttcttccagacattgttttagcactgagaataaaatgctgatcaaggctgggtgcggtggctcacgtctgtaatcctagcactttgggaagccgaggggctgggggaatgggggtgggtcacctgaggtcaggaccagcctggccaacatggcgaaaccccatctctactaaaaatacaaaaattagctgggtgtggtggcgggcacctgtaatcccagctactcaggaggttgaggcaggagaatcacttgaacccgggaggtggaggtggcagtgagctgagattgtgccactgcactccagcctgggcgacagagcgggactctgtctcaaataaataaataaaataaaatgctgatcaagtcaaacaagtttcttgttagagtggaaattgcattctggagcgaggaggcttttgctaaacaaatgaacaaagcatgaatagaagagcaggttgaaataagtgctatgatgaagctaaagccgggttatttgttggtggggtggcggctgccttagattgggtggtcagggaaggcctctctgaggaggtgaaagttaagagctcaataaaatgacagagccaggtacgcaatgctgtaggaagagtgtcacagaaagaactgctgatgcataagcctaaggcagcaacaagctggatgtgttcaggaacagaagggaagccattaatgttctaaaatcttcaaacaaatacattttgaacctgatttttttttaaaaaagcaccttacagattggtcctcagtctcacccaccaaagaaaggaaagataaaatcagaacaaggaataaaaatcctaaatacacattcaaaatccaatgtattgtacagcagatctttagaacttatttatggccgggtgtgttggctcacgcctgtaatcccagcactttgagaggccgaggcagacagatcacctgaggtcaggagtttgagaccagcctggccaacatggtgaaaccccatctctactaaaaataaaataaaaaaaattccgcacacctgtagtcccagctactagggaggctgaggcaggagaattgcttgagcccaggaggcagaggttgcagtgagcccagatcctgccactgcactccagcctgggcaacagagcaaggctctgttaaaaaaaaaggccgatgcagtggctcatgcctgtaatcccagcaccttgggaggccaaggtgggcagatcgcgaggtcaggagtttgagaccagcctgaccaacatggtgaaatcccgtctctactaaaaatacaaaaattagccaggcgtggtggcgtgtgcctgtaatcccagctactcaggaggcagaggcaggagaatcgcttgaacccaggaggtggaggttgtagtgagctgaggtcacagcactgcaccccagcctgggtgacagagtgagactccatctcaaaaaaaaaaaaaaatatatatatatatatgtaacttattcattcatcttctataactgaaataattgttgaacagcaatgctcattgccccccacctccaacccctggcaaccaccattctactttctccttttatgtatttgactattttaatacttcacataggtggactcatgcaatatttgtccttctgtgactgacttatctcacttagcataatgttctccgcgttcgttcgtgatattgcatatgccgggatttccttctttgtaaggctgaatgatatttcattgtgaatatgtaccacattttctttatccattcatctgttgatgaatacttaggttgtttccacttattggctattgtgaatagtgctgcaaggaacacaataatacaaatatctctttgagtttctgatttcaattactttggctaaatacccagaagtgggctaaatcatatgataattctatgttcaatttttcaaggaacttccacactgtttttcatagtggtggcaccattttacatcaccaccaatggtgtggaagaattccaattttccacatccttgtcaacacttgttatcttttgtcattttgataatagtcatcctaacaggtgtgaagtgatattgcactgtggttttaatttgcatttccctaattattagtaatattgagcacattttcatataccttttagccactcgtatgccttttgtgcagaaatatctattcaaatcttttgcctatttttttaattttgacttttatttttttgctgttaaattgtaggcattccttatattttggacattaaccccttgtgagacacaggtgtgcaaatattttctcccattccataggttgccttttcactctgttgattgtttcttttgctatgcagaagctttttagatctcatttgaagtattattacaataaaaaagtcttacatttagagttagtaagattttaaaaattagatcataataaacaagtatcccaaagaagatctgacaattaaggagagaaaaaactgtattgttcttttcttccttgttacaataataaaacctattcactatacagaatattgtggctgaaatctcgttagcttggtctgagttgcattttgtataatctagaggtgactgaaggggagcactgaggtggagctgtccactgatattttggaggagctgatatgttggagtctctaacaccacactcaggtttgatcatttattggaaggactcacagggatcagcatacagtgatactcatggctaagatttatcacaacaaaagaaacaaagcaacatcagccaagaaaaaaggtgcatgaggtaaagtctaggggagactaggcacaagcttccacaagtcccctcccagtggtgtcacacaggatgtgcttaatttccccagcaaaccagttcccaaggcttttactggggactggtacaaaagtgccctctgcctagtgtgatcccaaattccagacacccagaaggaaagcaggtgttcagcataaaacatagtgcatatccaaacagtttgggcacagtggaccacccttctcatttctgggaatggtgggaaccctcctaaagtccaagttcctagatgctagccaagggtcagccttgtaagcagccctttgaaggacagccacctcaaggcgctatgttagcttttttctgcataatcaggctctcatctctcttctgaattttgctcaatttcttttacctagatgtactgtaactggtaagggagtgtatgttatatccatgggaagacagccttaagatttgagttgttttcttgcttcagcatggatccctggaggcctaggttcccctggatagaatcagtcctattgctcacttccctttattgaagagtctctcttaggagctccttctcaccccctaacatatcagaaaacacaaaacatacacatagatattcagttaagtttacttcagatgtgagggtattttcagattttgtcatttaccaggtgctctactggggttatgaactggatattctttttttttttttccttgttctgggcttgtccttttagatgtgacaccagaagtgaccaccttcgcgtgactcagatcactgattttttagaagatttaaatcatatggaatttagcaacagcaagtggggcattatcactccagtttcaaggctttctgtttcttctgtaatgacagcttttcatgcctaatgctcagcgtactactgaaaagtgcataatagcttcccagtcatttgtcttctaatatagtacttagtaatgcagcttcaggaaccacgtgtatgaaaggctccatataaaaccaaataatgtaacactgttctactctaatttctttccctatagatgtaatttacttatggtagtgattgctaaaatgtgttcagctaatttgtaaaaccagtagaaaagaaaatgaatgtagaccactatattagtttcctatggccaccacaacaaattaccacaaacatggtggcttagaacaacagaaatttattttcccacagttctggaggctagaagtccaaaatcagtgtgtcaacaggaccacaattccctttccagtggctttcagtcatccttggcattccttggcatcaccccaaactctgcctccatctttgcctgggcttctctgtgtatcttctcctcttcttataagaatatctgtcattgaatttaggacctaccctactccatatgacttcatcttaactaattacatctgcaaatatcctacttctgaaaaagctcacactttgagtttctaggtagacatgaattttggggaaatgccattcaacccactataaccacatatccacatgtccctatgacaccataaaaggggtttccaatcattgctattctcaaataatgaaagttatagagggatttgtggatgaggcccaatcctcaagaggagtgaaccattgtcatattaaaaggaatatttataaaaaaaaaagctggaatactgttattcaggtatttataccaattatgtccagactaaaaatgttaaaggttttacgatttttggtaaaatgttttaaaatattggtacctaatgggaaatatatatctcatgaggtagtaataaattggtacctaatgggaaatatgatacttccatgaatctttacagagaacaccaagaacccagcaggtatgaaaattctatatttttgggaaaaatgattacaaaagacagtctctcacaccatgaacaatgatatattctcttagaggcagtgtaccagagcgtcaaggacaggggcttcaaagcagagtcacagtttggttcaattcagagctctaccacatgctagccctcatggtttgggccagatgcttctgagtctcagtttcctcagttgcaaaatggagatacttatacttatcttaatgcattatatgagggtaaatgagatcgtgcttgtaaaggacacacgcacagaagaaattcaagtaatgttggttgaatcaagttatgatctaacccaatctcaagacaagcactgactcaattttggctatctctgtggttttcctaaacaggttacactgacccactgaacttccattagcatattttgaagaagttattctaaatgccattataccccattcatttttctctaaggtcttcaaacttgggatctaacatttaaatcaaaacaacctggccattatagatccttcattaataaattgaatatggcaattttattcaacatctctggcttcttccaacaccagcccatttgacaagaacccatctaggtttgctgagagtattatctatcttatttcctcatcattcttatgttgatataactaaaatcatctgggtagagatgccagagggctagaatattctgtttcccagagggagattcagagagtttatctcataatcaatttacattggggatagagattaagtctgcttaagtctccttttgggacttggctgaatttgacaaaaaataaaatcagaaacatccatttttaagtgattacagggttctcaaggatgtaatatgcacaaccaaaacatccttcctctatctcccagtcagctgttcaactggtaagagttgtcagtgaaagaaactggagtttagagggcatgcagtctgattcaaacaaggcaggatggagacaaaagagaaaatggataacaggaccctatgagaatacaacctctgtttgcctttggcttttgagacacttgcaccatgttccaatactttaggaacaactgaactccttttaagagcaccaggattgctgtatgattgtccatctcatcaacatccatgtttgctcatcaacatccatgtttgatctggcccagcacactacttgttttttattttttagtgtttgttcacccaaccacactaactctgcaccaggttttcctggggtcatgagaggctttgtttattgtctttttttgtttcattttgctttgttttgtttcagccttcagggtgttttcattaattcctaaataagtttcaaacttataccaaaagaaaaaacaccaagcaacaacagaaactaagggttggaaaggatttatttatagcaaccatccttttcatggagagagtgaccatcactctctcaaaatggtcattgagccctgcataaatcatcccatcattctcagcaaactattgcaaggacaaaaaaccaaacaccgcatgttctcattcataggtgggaattgaacaatgagaacacatggacacaggaaggggaacatcacacaccagagcctgttgtggggtgggggaaggggggagggatagtattaggagatatacctaatgttaaatgacgagttgatgggtgcagcacaccaacatggcacatgtatacatatgtaactaacctgcatgttgtgcacatgtaccctaaaacttaaactataaaaaaagtacccagtactaaggcactctttatatactcagctattttgtctgatatctatgtagtctgactgttctcatcaaaagtttatacaatctgactgagaattatctttgaaattgagttagaattggtcttgctatgattcttctcattgttctcccattttattagtatctttataaactcattggatgctaatacatttgaaggtttcaatttattataattattattcttattaattatcaaattgtcccatatttggtcaatgtcatctttgttcaagttgggtcattttgacctaactccatcagtcttcgataactctcttgctttgtggtgtgacaagatgttccaggctcatcttgtacatttctttattaagaccaagaattagccattgctctaagaagacttggggcattttcaattactttcaaagtcacacttgggagaaatttcctttcttgaatgatattttgtctgattattaaaataatattccttttgatagaatatactaaagaagattaaaaaaatagagccactgataccaccatcatccagaaataatggatgttaacattttatctctggaaccatctttccacttaaagtttcatgccgtgcctttcctttttctaaacagtaggaaaagagatgatgaatgaaactagacattttaaatatttagacaaaataggttgaacacatgttttaacttgttaatcatttttgaaaaatcctaatattggccattaaacttccagggcaagctggtatatgtgggaaactttaaatttgagtaatttggattttgcaaaagtctttttgctaccattgttggctaatgccaaagattgtctgcagagctgtaagaatgcactggaaggcaaacagtactgtatatattaatagaaatgaaaagagggtaaaatgaaaagtcattatagaaccagagagtatttttttaacttatcaacttttcatgtgtagcatgtataataaagctcttacaatgtttaaagctggggttttagattgatggagagctctataaatcccagattactattaatgtgcttgtagtccagctctagttacagggttgtcattgtttccagtgaaaaggtttgtttttattttttaaagatctttagtagcctggaagaattaaaatggtgatttctagcaattttaagcatgaagtagataccaatgtcattcacaaaataatatgaactaattgtctagttaagtgtctttaatatctttgttcccctaagtgagtccaacatgaaagcaacctaggagctgctccctctccacccccatatcattggattccaccttactcgaagctcctgtggctgaaagaggactaaagtggcattttctgccaggctttgtcacgctcccttttgcccacaggtgctttaacctccaaggggctttttgtgcctacagggatattccgcactctttgtcctttgtttacagtccaatttcataaccttatgaatttgtcaaacatttagcattttttaaacctaaaataataaacgttcctcaaagcacagctaccaagtcaacggcgtaaatagcccttgggagcttttcagaaatgcaaattctcaggcctcaacccagacctcctgaatcagaagcagctggctgtattttaccaagtcctcctggtaattctgatgcatattcaaattttcattgctttaaatattcacacactacttatacaaccaataaatcaaatgtatattaagtgaacaaaacgaatctactcaaccatttacacattgattgcaaacttaatgaaatgcttttaaacatttaacttaatcacaagcctaacatttcagatttccctgcattaaacatcttacaaaggaaaaaatacacgtaaaataccacgttgtttacatagccgattattattttgacaacaaaactgggcacaaagctattaatatcatagatttaattttgtttttttattcttaaatctccttttatttttacttttgtatggtcctggaatttaaacttctgtacattgctggattgttgggaattctacaagagactctttatactttctcagggtttatgtaatttttccagactggaaagaacaaacatatcacctcgggaagtcagggatacaggttaagtggattactggccacttaattttggttggttagtgggaacgggttgctaaattcaaggtgacttaaactcaagttgctggccactagacaataattttttatcacatagtttttgttttttgtcatggaatctatattgttttctcattgctgctttaacaaattaccacatacttagtggcttaaaacaatacaaatatattatcttacagttctggagggcagaagtctaacatgagtgtacagggctgtgttccttctggaggctccagaggagaatccaattccttgtccattccagctttcaagggctgcctgtatccttgggcttgaggccccctttttccatcttcaaacctagtgtcttcatagcttctcctctcatttctaacctcctgcctctctcttattctctagtgttatattgggcccacccagggtaatctccccatctcaagatcactaacttatgaatatgaatcttcaaaattccttttgtcaagtaaagcaatacattcattggttctgtgggttaggacatggacatctttggggaccattattttgtctaccacatgacactttttgtcaatgtatttcacatttttactgtgcatacacatatacacaatgtattttttaattaggctttacaatatataattttattgcccggtttacaactaaatatattgtgaacattttcttttcttttataacagttaaaataattgcatagtttggagaaaacataatttactaagcaatcttgttggggaaatttaggtataatttttttccaaggagatttcattcttttacaatgctgttagaaaaaaggagagtctgtcttatataactttctatagatgatggaaacttgcccttcaatttagccttttaacttgcttctctacatccacctaatcatcagtcaagtaattcattttcttttttcgtgtccatctctcccatttgcttcctcttttttaccccatctccctggcacacatgcagacagatttctattactaccccagcgctttctgatccttccctccatggcctccctttaatgaggctttctttcattttaaagagaccattttaattgattttgatcaactctactcaaaactttatcctcagtttcgcattaggattagcctttaataatctgaagatataattcaattgtttaaaagaccgtgttaataagaccttggtagagttacatgtatcaagaaacataggacttgggcacaatgtacatacggctgactttcttttgaaaaaggaaagtagtttctgggggggggcagggcagaggtaagaagtaattggtacgtgaaggaagtgaggaagtgttagggaccattatggaaatgtattctttttttgttttttgagacgaaatctcactctgtcacccaggctagagtgtagtggcatggtcttggctcactgcaatctccacctccctggttcaagtgattctcctgcctcggcctcctgagtagctgagactacagtcgcatgccaccacaaccggctaatttttgtatttttagtagagacggggtttcactatgttggccaggctggtctcgaactcctgaccttgtgatctgcctgcctcagactcccaaaactgtattcattattttaaggcaactaacaaatgatcttctttcagttaggacattggagcagcagactttactggtcatgaaatttgcatgatatctaaagttgttatttctggaaataggtaaatgtcagttcatagtaactttgtatggaaaggcatgtgccagctagcataaaagtggtacatgcagatggtagttttccagagtcctgggagccatgaggtgctcaaacatcacaaggccatcacaaccaggtagaaatgcctcaggaaagcagaggggttggccatgccagcatttacacataaaacgcttcttgggcagccagatgacatggtgcacagacccacagttctctctgcacacaacatgctcacagttccatccataggaggaagggaagacacaaaagcaccccagcgtgcaggttcccccatttggacagcaggttctgttttgttccttactgtcctgtgtccccatggatggcacaaactctgaaataaggatgaattgcaggctcctcctggggctgagtgctgtcccctctgaaagccaagtcttcctgagatagacatgcaagttatggtggcccaacccaacctggccaactaattctagttcaaatgcttttgaaatggccatgatcaaaattacactccgtcattgtcccctgaacgtttaggcaggccagaggatgagagagagcagccgtatttttatcttttaaattgattctgtttttttttttttgagatggagttttgctcttgttgcccaagctggagtgcaatgcagcctctgcctcccggattcaagtgattctcctgcctcagcctcctgagtagctgggattataggcacatgccaccacgcccggctaattttttttttttttgtatttttagtagaaatggggtttcaccatgttagccaagctggtctcgaactcctgacctcaggtgatccgcctgcctcagcttcccaaagtgctgggattacaggcatgagccactgcaccctgccatggattctgatttttaaagaaatttagaagatttaagttttgtttgtttttaatctctggcagcacatgactcattgcaatatttaataatatattaacctggcctggtttcaatatttaaaaacattcatctttcttattggcattgtgttgtaattaattagttaaatcatcaaaagttttcatttccagagaaacagaaaagtgaatcttaaaatttagacttcttagccaagtgcggtggctcacgcctgtaatcccagcactttgagagtctgagacgggtgatcacctgaggtcaggagtttgaaaccagccaggccaacatggtgaaacctcgtctttactaataacacaaaaattagccgggcgtagtggcgcatgcctctaatccaagctacttggtagactgaggccggataattgcttgaacctgggagggagaggttgcagtgagccgagatcatgccactgcactccagcctgggcgacagagcgagactccgtctgaaaaaaaaaaaatttagactactttttatggacatttaactaagttagtattttggagtaaatggttattatcgttttcctcattggaaattgcatatgcgactggtgctagccaaccgctggactccttttctagttcacttatatatgagaccacaaatgctgctgaggcctgtttattcatggtacagtttctactatttctaggactgtttggcttacaaattatgttagtaatttgtggcttatgcagataaaaacaatacatatctatactatatgaacagaaatatacttaacaaaaacccacaaatatctatctatagttatatataaacactttcctacttatgtaagtaaataaatttacatgtacataatattcactcttctttgatattactattataattttgtacattttatttacattaacttttttcttatgtacatcatgtccctttagaagcataatttatttcatttcatgatctttattactacaaatgatcacaacttgaaaaatgggagctcctttaagctgactgtttttctttcagcagtgcctctgccatttaaaaaacaaatcactcttgtttcctggcaagaacaaaatgttacagacctattctgattttattctgcccaataacgtgaaactgactatcctctaatggtttctggttctttttttaaaaatagaacaatattagagacaaaaatctggtcactagggatgtttacaagtgtcaagtggggaaagactacagctactgctgctgccttgggacttctcttgctagcgactgagcttaaagaaaatacgtcttttataagtgtgtaaaatcttgttctttccagtatagcttatcatatcgttatcccttacttttcttattgtatgagatttcagcaattactaagagtttcttcctctacattgatccactgtgtcacccagtggcacagtagcccactttcctcccacctcctctctcactccgttttctaggacaatggttctcagcctagtcttcatactggattagcttggggagctttaaaaatgttgatatgggtctcactatcatagcttctgatttaaccttccaaaaagcagaatatggcatcaggattttgtaaaagctccataggtgatactaatgtgcagccaaagtaaagaacctctgttctagaaaagtgttgcaacctgaataaagccaaccaggcatactcccatgaaattacaccacagaggttccagggataccagcttgacattataaacagaaaaattaaatgcatgcttatcttttgactgctttgcttcaggagttttggggatggggacttgctaaagagagaaaaacacacctgcctttttttcagtcttcttgaaagactcatgtgtacaggtcgttgacttctccaattgttctgctagcatttctgtctttcagtctcatcttcctcactccttcctaaccttgctctaattacttcaaggttttaaaaggccttgatttcttcatctttgaggttaagataatgtctgcatgtgacacacactaaatctagcaaaattcaacaacatactgtaaagttcgagaaaaccataacaggttggcagcctaaggtcctagctgcctaaaatgatttgagaggctataatagaagtcaaatctgcttttctggctatgagattccagaaggtcaactgcagtgttaatccagactttttttatttgtctgtacacactttagggagtgctacatgtttaaagaagtctgaagtatgacctctaggattaaacacccctctgcccccaccctctccttctctctctctctttcttggggttttagacatcataaaattaaccaattcatctgatatagggaattgatagttgattataattatataccttattgacatatctacctccacttaagttacttttccatgacagaagcttgcattcttatagtatgaaaaacagaatgtctgttttagtaagaggacaaaggcctaggacctactctatttctgtgtaatctattagtattagttcttcacttagttccgatacacacccaagtctgggaaccattgtcttagggcatcaaataagtaagggtagttgcttctctaacgagaagggccttaacagaaggtggtgaactattctttgctcagaggagtttagctgcctttttccctcaattccctccctgccaaggatattatagacagagtcttctgtttttgtgggctgccatctcagaagctttgtctagtcttgatatattgcctggttaggattttaagaaaataatagatgatgctttcaaaaatatggcagtctcaattccctctttcttaggagtctcaaactttaatatgcaaatgaatcacctggaaaccttgttaaaatgcagattctgcttcagtaaatctgggtggggcctgaaattctgaagatctaatatgctctcagatgatgctgatgttgctactctgaggggcaaggtgctagctttggttctcaactttggcagcacgttacaatatagtaagaatatttttaaaaataatgatccctaggtcccactcctagagattttgatttttctgatttaattgatagagaatatggcctgggcatcaagagtttaaaaaactctccaagttgccaggtgcggtggctcacgcctgtaatcccagcactttggggggccgaggtgggcggatcacctgaggtcaggagtttgagaccagcctggccaacatgacaaaaccctgtctctactaaaaatacaaaaattagctgggtgtggtggcgagcctgtaatcctagctacttgggaggctaaggtgagagaatcgattgtacctgggaggagggggttgcagtgagttgagatcacgccactgccctccagccagggagacagagcaagactccaactcaaaaaaaacaaacaaacattctccaagtgactttcatgtgcagcaaaatttgaaaaccccttgtcttagtccaccatcaaaagttaaccaatatcacatttttttaaaaatggctcttttattcacttctcatgctataaaatatagcgcgcttagatagttcaaagcagtggtttacaaatctctatccccactgaccctggtgtggagaagcttccatcagaagtggtagaataagaaaaataaggataagaattatatagtaaatttcataaagctcaaataattcatttcaaggattcttctttgaaattgtctttcacacctttttgatgttaaaatatcctttttaaattaaattaaggtagtaacattatacctgtttatttgcttttctcatgctcttaatttggtaaataaagagttgcaaatcttatgttgatctccacatatttttggaaatcttgctggttcatgaaatttgaaaatctgggagccatgggcatgataaatccattaaaaattagaaaaaatctgatctttaagtctagaaaaatattgttataggaatatagtttttaatctttgattctctaatccctggggccaagcagtccttgaattttgtaagcaccagagtttattgctttctgtgtcagttcaggtccactaagcagatttcaagaaggaattagacttgcaagagatttattgagggaaccaccaagaaacataaagagagaggcagcaggagtgggcaagagggccttcagacagggaggcaggtctgacccctgtgggaaagaaggatgcgtgggtagggagagagcctcagccagtagcgcagctctgagaaagtctcagccaggctggtggggagccccagagcacagactgtctatcagagaggtccctgtcacgcaggaatggcccagcgctattctccccactgtgttctgtcatcaggttggaacagcctggggagggtggccttggcaggaatgctgcagggcatccgaaggtgtagcagctagagtgtcagccaatggctctcctcacagcaagttctcttctgtagggcgatctgtgtgtgcacttccatggctgccacactgggacttgcaattccacagtgaaaatgtatcttttttctgttggatgatgtgaaagaaaattagccatatggcaggtcattaatgtttctccgtatatcttgcttttggtcttgtcccttttaaccaatggccatttattaattataactcatcattatgtctgctgggcccacaattatctccataaaaaatgtaaaatcgctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgttttattttcaaataccagcttgacaaagaattacagcttgtgtgtgcattttctggggaaaacaggacattgttaaaaacagactctaagatcgctctgcactcaaccctattcccaaacccttttagcccatatctcatcttatgttctgtcaatccctttgatttttcggtgccatatttaacacaatgaatgaatagagaacactggagcatacaaaatggacaagccatatgtgattctatagacatcaggtctgtggcttgggagtgaagactggtggagtgtgctttgaatattcaaaaaggttagttactaagtcactctggaagagggggacactttctatcattttaataaactggttatttaaagtagggttaagaatatgcagaatttatagaattggggctcaaatttagccattctagtcctcccaaattaggaacttgaataactttgaaagattcctcttgtttggtttgccacagccaatctacattatattgcccctggaaatcctaacagccatggtttctatgtctatggataactctgaggagacaagataaactggataggcccatcttcttccacatttgaataaactacacacatttaaatgtgaggttaagctcaaaataaaacactttggacatgaggatgagatccatgcagagaagatgatataattatgtcagataccaaagtggctgtctgtgggtgtggctttacatatacaccagataatttaatgcttccccctggggctttatcattactagattataaattcattgagggaaaatgagctgtcctattcatcataatgtcccctgcaggaccttgtgcaatgccttcatataggagacacttaaagtaggagctgaatgaataaatagcagcttgttaagagcatggaatctaaatcagatggatctggaattaaattctagcttagccaactagtagttctgtgatctccaaattgcttagcctttctcttttttaatctttttaaatatataaaatatatgaaacctacagacacttcaagaaaataaaacaaacattcatgtgttcacacagttttgtcaattcttaacatgatgttgatactttataattctttgctgtttttcaataaaacattaaagatagagttgaagcccaccatgtaactctgcctaatcttattttcttcctttccacaaatatgttattatcctgatgttagtatctttacacatatctatagccataaacaaccaacagtattattattattatttttgttattattattatttgagacagagtctcactctgtcacccagactggagtgcagtggcatgatctcaactcactgcaacctccgcctcccgggttcaagcgattcttgtgcctcagcctccggagtagctgggattacaagtgtgtgccacgcctggctaatttttgtgtttttagtagacatggggtttcatcatgttgaccaggctggtctcgaacttctgacctcaggtgatccgcccaccttggtctcccaaagtgctgggattacaggaatgagccactgcacctggccaactaacagtattattgagcatctttgtcaacttcgtataatgggaacatgctctgagccactatgctacactgttccaggtattctgtatttcccctttctcataccaaagaatttcagctccataaaagcagtgatttttgtctcctttgtttattgtatctccagggccaaggacagtgtctcagtgtctggatgttaatggtgctcatttgtatccaatgagtgaatacaactaagactcagatttgaaatgtatgaaactcttagtctctgttcaagttcatatggtgtcttggtttaagatattaagacattttaccacgtttttgggattgtacattcatattattgagttgctctgtgtaatgcaaaaaaattgggaattcattccttctaacaaggcactaatactgagattaagactatttattttaaccttagtaattgctacacataagcgaatttacgcctggatttcatctccttcatcccgtgccttttaggaacactatagctctctgaaaggtcttaccctcagctggatcggggatgggaacaatatcctgcactccatcatgatgagcgcagcgaaattcggaatgcaccttcaggcagctactccaaaggtagggaaactttttgccttgaaactaacccctctcttaaatcatcctcagatgcaattacccagtgacaaaaaaagctctcttccatttaagtatagcacaggtgaggccacagaatttaggttacgttaccagccctactattaaatagctatctggcctcttgagagtccaatttcccatctctacaataagagatagtcttggctgatgccttttattctatgagttagtgttaaaagcatgtctgaattattcctttgaataccctgctgtaggccattatgatgactggcattgtgcattaccaccacaaaggctgaagaaagcaataaaatccaggcagcatagaattctcaacccatgggaatgatactgtcatttttctaacactgcaatttggtagaaaaatgtgaatccaatgtgaggatcacagtgatggcatctacaccagcttagtatttcaaaactcaactctggggaccttttggcttagaaaatttgagccccacatggctatgaaaatgacccctgcatacttcctaccttgctgctctctcacagcatgtatggaatacatgacttctttcataggcccaatgtaaaccttttgatacacaagaaactggtaataattgttgcctctgaggagaggaactgggaggtttgaggatagaggtaggagggacactttattttgaccatacagtcatgtgtggcttcataacagggatatgttctgagaaatgggtccttcgatgactttgttgttgtgggaacatcataccgtgtacttacacaaacgtagatggtatatatttttatttatatatattctttcacatggaaaaataaatgttccagcaccattactaaatatcaaccttaggccaggcacaccaccacaggcacaccaccgtggggatttgtgtacaggtgatttattaaggaagtactgccaagggagatccctaagggattagggggagcaggacagggaaagggaagaatctaagcaaggatgccatttacagtgaccaaccatcctgatttgctcaagatcaagagatttctggggacatggggtttggggtgctaaaattgagagtccgggcaaaccaaggtgatttggtcaccctagtcccatgtcgtgcacagtcccacagaaagtagcttcagcctgatctcacaggtgagctctggagtgtaagttatgccctaaagttatcccagcattggtcaagggcagcagaagaggtggagtggtaaatcccctggcacttttgatgggaaaagcagcctggtagccagagagctgtcccctgaagacaaactgcacgcactaggtgttaaaaacactgaaactggggaagggagcagaagccatgaaaagggatcccccgggggcctctgagtagatcaccaacatcatctgctgcatccagccaaaacaaaactaaccaccaccaaatgcttcaccaggtgtttttatcttgctgtcttggattcttagggctgccataacaaattactacaaactacacagcttaaaacaatacaaatttactctttcacagttttggagactagaagtttgaaatcaaggtgttgacaggccacactccctcggaagcctctcagggaggatccttttttgcctcttcctgcttctggtagccccaggcattcccattttccctctgtgtctgtgtctctctgtacaaatccccctcttcttatagggacaccagacatattaaatttaggcccactctaatccagtatgaactcatcttaactaattacatctggaaagactctatttccacataaggtcacattctgagtttctgggtgggagtgaattttgaagaacactattcaaccaagtacacctgccatagaaaaaatgtactgcatgcagtggaagtcatcctattatagtaaatttgagggactcagagagatgacccttacaacagataattctcctcttttattcagcgtgaactgaaataagggtcagatccgatatgtgcttaaagcggcttttattcactttatgggaagggtgagtacactctctatacaaagctagtttgaagaaaggctctgtattaatgcaaactcttattgcatttggttcccacagatgaaacatacattaacaataattgctccctgctatgaagatcttttggaaggctttattctgttgaagaaatatatggtttaaacattttattgcatgccaaagatgttttattaacatcaaaggaaaaaattctaatattacagagtaattgcagtattgttcttaaggagaaactcatttaaatgataaagagtactaaaacctggttaaaccttggtgggagtaagagttttgcaaagtcttctggaaagtctgatagtgcaaaagtcattccatcaatttgtaagtcttcagttgttagtagacctgtttcctttaaagataaagctaggagatttattgtaaattttagaaacactgaaacgtttccaaggccatgattaatctatttccccattctttaaccaagaataacttacatgttcaagaaaaaataattttgtccatgattgtaaaattgctccataaactatcaatagtaatgattttaacattgttctaagtgaatacttagagtgaactgggtgtgttaatcaccttctttgtctggttttaaaatttatgtaaaggctagtgagtgatttagtattgaaagctgagatgtgagtaaagaattcctctctgtattctaagtcatgcctcagtgcatgcaaggttgggtgattttctaatttccagacctctctgttggttctctaagtacttattgattccttttctaagaattattgtacttagggagtataaaacctactctccaaagggaaggctaaattttcagggtaggaggcacctgggggaatatccaagtctcttcatttatgtttaccagtatggctgttcacaacattagttgctaaattagctagcctttattaattactttccccaaatctctataaacaaggctccagaattcatggctatatgagggtggtaaagctgctaaaatgtctgcaggcatcttcatcaacatctgagtagtttcttctttcaagaatgctttaatagaagaagaaactatggtagacaatcatgtgcaaataaacacaatttcacaaataaacctagacatgcctgtcacaggttgggtttcttgggaagcagactcagagtttagtgtgcaggacaggcaggatgcttattagcatgtgcccttgaaatcaacaactgtggaaaggaagggaaggaagcaggagtaagagggagaagctgagttgcgatgcagacccaacaacagccttggctgatcttatggaaagttctggatctgagatgtccattcatctgtctggagttgggcagaggagggtcaggttttcataccctcctgtcaatcagccattgaatgtgggttgccccaaaagggtgtgtgaccttgggtgcggctgctctctgcagcagaggcagtgcccaaagggggctgacagctgaaagccgtcttctggcagcactcccagcagctgggggaataagtcctttattcatgattattcctggagggggatctcgggagcataccacagcgttcaccacaatgcttcagtgaaaagtgataaaaatcaactcataatcaatgctaagaacttgggaaaatgagaaggatagaggaaggtgaggataattacagtgtttgaactgacaagacttccatatggagggtcttggaggtgaggctgggctagagttttgaggagctgacacattgtgatgaagaagcccaggaggggacaagagaggaggtgttcaagggtgaaaggctgtgatggcagaaaagggcaagatgtgtacagggatgacaataagattggctttcctgcagcaagatgttgagaagaattaaaagagacagaagcagaggatggaggtggggagccttgatgctcttaatcagctttgacttaagaaacaagtagtaaacatcagaggcttcagagaaaacagttcttgctgctgtgtacagaataggttggagagtgagggtagaggcagggaggctgcctgtgggaatctgggataccttggggagctttagctgttcccatgatgtctcctcacccagagtaggaactaggctgagcaagcgaggcacctagggtgcagaatttgtgcatgcatgaccctgagaatgtgtgtttctttacattttttctagcgcctccttaaatgttttgccctaggcacctcgcttgcctctccagagtctgactctgccctcaccaaaccatcccggacaaatatataatcttagcaaaaacaatgtatttgttctgtcaatgcctttcaaaacaagcaccctgccctcaaaaggcttgctggggaatgcaaaagaatgagaggtgtgtaatgggggagggggagctgttagtatttagctgggatggtcagggaaggtttttctgaggaggggacatttcaactgagacctgaaaaagttatccacatggaatgggtggaagaaagaatttcagacaagaaaggatagcatgtgcaaagatagacaaacatgcattcatttgcacacttctgaatataatcctcttaagccattatggaaaccggaagaggtgcttccaagagttagaaagcaccatgccttatgtttgcctttatgattaaagaagtcggagatagtgaaagctggggcaattggttgtctctttaaattccaaaaggcactattgagttttggaattctagatgtaaaaatcatattctactgaacatggtgggaccacatcttgaaaaagggaaggagacgcgatattgaaaagaaaataatatatatttaagaaaacatgtataataaaattacctaaataagatttaaattcttcctcctttagggttatgagccggatgctagtgtaaccaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaaggtacaaattgatgcctctctgaaggttcattaattccattcatgaaggccagaaccatctaatcacttattcactttagggggagcagactgtcctttcattccctataaaaggactcactgactgtatcccctagggacttctctccttccaaagattagctgtgtcctttggaaaggcatttttgtgctggatgaaggaatttgaaacccactgagaagagaggagcaggcttttccctctcacaagaatcgaggcattgcagtgttttactctttgtgtgtttagagaaattaggttacttctgatgcatgcagtttcttatgatttctcccctaagaaaagccccttaactatgctcctcaggctagtccttgcctctattttccaaggacctctaaatccagtttagttttgctaatgccctccagggcattcccaggggactcatctgtttggctgtcttccagtaagatctggaacaatgcttctcagtcttgagcaggtattagcatcaccagaggagttgttaatacacagctggctgggtcccacccccagggtttctgattcagtaggtcagggtgaaacctgagaatctgcatttctaccaagttcccaggtgatgcagtgctgctgcctccagggccacactttgagaagcaatgttctggaggaataccctgaaagccaaatgcacaggggttttgtcagcaaagcaacaaatctactttggtggagaaagggattaagcaagtacaattaatattatattgataaagtaatacataaatacaagttctttattgttatatataaaatagaacagaagtttgaaaaataaaaagtaaaaatgtctttctcccatctctttaacagagactattcctagaggtagcctctgtttaataatttgatgtgtctctttgcagaccttttctgtgcatttacatatgtatgcctcaatacacacataactattgatttttttgtaaatgatattttagacattacttatttatttattattattcttactttttccacttaacaaatcttagattttcttgctcactcatttagatattttttattctttttagttgctgcatagaattccaaaggataagtggaaccataatttacttaaaatgtttcctattgataaattaggctatttctgagaatgccgattacaaaaatgctgcaatgaacttgcttatccatatttctttgtgcaaatattactggagaataagatcctgaggagaggaattttggggtgaagtggtataaattttttaaaatatgagagtgctgctaaattgcttacccaaagaagattaaaaatgtatactgctgcagctgtatattatagttatttttccatatcctctccatgtttagcttttatttacatttttaatttttctaaatctggaggaaaaatggcacctcatctttgttaaaatttgcaattccttgattactaatgaagttaagcatctttttatgtttattgggcattgcccttttttctataaattgctattacattttttgcccattttctatttttttgccttttctattattggttataggagctctttatatattatggctaatcccttatcatgtggaatatattttcatggagatattttaaattatataaattgcttcatacttacacttgcttggccaatcttatatgtgttgctggtgctggaactgtaggattgaagaacagtcattttgttgatgtatggcatttataaatgttacttttttccatgtaattttgctggtattttagaaactcaaaatgtcctgaacctagagcttgggtgggaggtaaaacaaaattgtagtacaaaggcagtaattttgaggtaagaaagtatgaaggaatgtagttttgaatctgtatgtgaacaatagaaatatatagggaaatgtaactttcagcaattaactgttggagaaaattaaaactgctagtacatttgcattaagaatgaaaaatctaatgcatagtgcttataatcctgtttaattcacccctacctcattacctttatctaaattgttttaactagtgatggagtatgcttcaagtgctaaaaataataatttggagatcagctccaaatataatattatcacaccaaagcaactttttaaatatagtggactataattggtgacttttgctatcagccacatattacattagtagagttctttactgaaaggtctactgttccactaaatagaataacagaaaactgagttactggtgtaacttgaagtggtactctcttaaatttaaaaagaaaaaaaaaaaaaaaagacttgccagacacggtggctcatgcctgtaatcccagcactttgagaggcgaggcgggcggatcatttgaggtcaggagtttaaaaccagcctggccaatatggtgaaatcccgtctctactaaaaatacaaaaattcactgggcatggtggcacatgcctgtagtcccagctactcaggaagctgaggcaggagaattgcttgagctctggaggcggaggttgcagtcagccgagattttgccactgcactccagcctgggtgacagagcgagactctgtctcaaaaaaaaaaaaaaatttgaaagtaccatgtacatttctcctaggtgtcttgagataaaaccatcactctgctcctttgtctctccctttgcattgatgtctgactactggccatgtgtgtttttagatactgaagaaaacaaatatgactgccacatataatagtcaaaaagtggtcttatccccatctctttagactgctaaagttgctgcctctgactggacatttttacactgcttgcccagaaagccagaagaagtggatgatgaagtcttttattctcctcgatcactagtgttcccagaggcagaaaacagaaagtggacaatcatggtaagcaagaaacaaggaatggaggataagttctttgtgtggttccaacttggtcattcatgcctttggggaaataataagcaagtgagattatccaactacattacttgctcatgtaacatctatttttttccagaaactttataatacatcattagtgcttattagcatttatagtgtatttgcatggagtgagattaatctcctttcaaataaatccattttaaccaaaattcttaccacccttgatccgcctgagcaccagccaccagtttgccaaccattataagtcatataattcttattttagaatctctttgttcatgtttagagaagcccctaattcagttcctgtataaaatgggcattcaaaacatcttactttttcccttctctttttcctcattccatgccttactttatgactggactagatacttgttttcgttctttgagtttggccatagggatatatgtgtttttaggtatagaacatttccaaatttcatggcaaaacttatcttaaaaattaatggttcctttcagataaagccactagtttcatcttcatcactgtcattctaggaaatattaaccatatgtctactttacaatatcccaaatgtcacctgctctggaaaatagtactgacatgtctaacttagctccaccatttttttagcttttagtgacttaactggtctcaattactgtatcagccaggatcttacttgcaaacgggagtccactctaggtagataaatggaaagtaatgtattaagagacattaagcggctcccagaatcttttgggaaaggaagtgcagtgaataattcttggacaccatatagccagggacaacacaggcagaaaaattgcccaatgacactgtggttcttttgtagccagaacaccactgacacagcctggtacctgaggctcttgaaaccagatgtcagatactccattatagccaccacagctgaaatagatttctctacctgcatatgtagcagaagatccaatctctccgaagacggcttccactgcatgttgtttgcttctgcacccaagtctggagtagatgcagctgagtgggatgcctgtaccctagctgcaagggagtttgggaaaggcagtttttagctttcagcctctggagtagagaaaagcaagctggaaaggactagcttctaattatttatctaatctataaattggaataggtttattgtgaacattaaagtaatatgtgtaaagcttttagtatagtacataacacataacacatggtaaatattgttatcataattattaccctcattatcatcatcttcactattgatctgatacagaccctataaaataagcaggggttcaagctcaactatggctgcttggcagccaaccgtgactcccttttcaatagaagtttgtatattaggcctaaatttgtcatatctaataacagggatgattttttttcactgcatctttccagcttgccacctcaggacactaactttggccaaaatgtcaattgccttgttatctaggccagtacttctgaagccttaatgtgcatttaaattacctagggggtcttgttaaggtgcagatttgaattctgtaggtctaagatggagcttgagatttggcacatctattttttttttttgtttttttttgagatagagtctcgctctgttgcccaggctggagtgcagtggtgtgatctcggctcactgcaacctctgcctcccgggttcaagcaattttgctacctcagcctcacaagtagctgggattacaggcaggtgacaccatgcatagctaatttttgtatttttagtggcgggtaggggggtttcatcatgttgcccaggctggtctcgaactcctgacctcaaatgatccacccacctcagcctcgaaaagcactgggattacaggcgtgagccaccgtgccaggccggcacttctaataaggacccagttattgcaggtgccaccatcctgcagaccacattttgagtagcaaagatctagatgacaaagaaaatgtgagctctccaaccacatacctcaggaagagacacagcaaaacattttccttgagctctgtttttcatcagaagacaattgaagttacaaagatatatcaagtaaatccatcaaagtagatcctttgtagaaattcagtagggaaaactaaaaggaaactttccaaaacatcaattatggagatgctctgaacttcttatcttttaaagagcttattaaacaacgtctttaaaaccaatttacttgaaaaattaaatacgtaatgtattcacatggttgaaatatttatggtgaaatcttacatccacccatttttccatccatctagatcttaccgccatctccccattccccatacccctgagttacccactattattagaggaaaatattttaaagaaaccaagagacagaatcgtgttaaaatgaaagtagagagtctaaagtagaaagaatgctcacctgggagtgatgagacttgacttctgtaactggccttaatactagtcagctgtgccatcttagcgtctaagtattaactctctaggtcccagtgtcctctcccatgaaataagcagattgagccatagagatggcaaatgagttttaattcttagatccctaatctcatcaacaggctacaggaattctgttgagaaggattttgagcctgcctatggtgtgagacagaaagagtggcataactgattagcgtgccttacacggacgctagaaaggaggtggtgatacatgtgttgcgctctttatgtctctgagctagatgatttggaggtccctttgagttcagttcatttcagcagccatatagtgagcatctactctatgccaggtcctctgccaggcattggagattgaaaaaaagagaatagtatgcagccaccacacagcctgtacagttcatagaagcataacattttcaagtgggatgagaccttagagactatccacgctaaattcctattctataggcaaataaattattattattattttattattatttttattttttgagacagagtctcgctctgtcacccaggttggagtacaatggcacgatctcggctcactgcaacctccgcctcctgggttcaagtgattctcctgcctcagcctcccaagtagctgggattacaggtgcccgccactgtgcccggctaatttttgtatttttagtagaggcagggcttcaccatattggccaggctggtctcgaactcctgacctcaggagatccacctgcctcggcctcccaaagtgctgggattataggtgtgagccaccacagccggccgcaaataaattattcttatacagcttatttagaatggcctttaggttcagcactgccgtgatacatttttctaagatgttctaatacttgtcttcctccagactaccctatccaatacagtagccagtaggcacatatggctttttaaatttaaatctaagctaattaaaattttacaaaattgaagattcaggccaggcgcactggctcatgcctataatcccagcactttgggaggctgagacagggggattacttgaggtcaggagtttgagaccagcctggccaacatggtaaaactctgtctctactaaaaatacaaaaatattagcctggcatggtggcgcacatctgtaatcccagctactcaggaggctgaggcaggagaattgcttgaacctgggaggcagaggttgcagtgagccaagatcgtgccactgcactccagcctgggcgacagagcaagactccgtctcaaaacaaacaaacaagcaaacaaacaaaaaaagagaagattcagttcctcagttatactaaccaagttgttgaatgctcaatagccacatgtggctggtggctacactattggtattggacagcacagacatcgaacacttccatcactgccgagagctctattggacagcactactctagggaataatttccacgcatgcaacttgatttaaaatgaggatgaaataagaaaggaaagccacaatgtcgccctccagttctgagatgcctgtaatgactgatgtaaggtatacactaaaataggatgaagggctttttctttaatggtgtagcattttttaaagcagaagtgtcctctttcagcactcagagtagctttttaaggcctccatgctaagagatttccagtagtgctgttcagaacgcttcactaatcgcatcattctcttcatagtgcacaggtctttggacccctttgtttagaaacaaaaatcacacttttcctccccatgaagcttgcttttgtatttttcagtgattaataaggcagtaggactcacaaaaagtagatagatgttttccctctgcctataaattttacactggagctaaaataacctaaagggaccctgaaaaaaagaaaaaatgctgacacttcaaagcactgttatccacatatgactcttaagtccaaaacaccattgcaaatgtaattcacaatattttatagtcatttacttctccccaagttagagttgccagataaaatagaggacacccagttaaatttgaattttggataaacaatgaataatttttagtctaagtatgtctcatgtactatttagaacatacagtaaaatatatatttgttgttatctgaaattcttatttaactgtttgtccgtgtttatttaactgaatctgacaatcctaatccaagttgaatttgtaagtttttatttggaaataaggttgacacaatccatagacaattaaaaacaaagcaaaaatgagaggggctcccaggaacccattaagaagtttacagtgtcttttacctggtagacattcttatgccaaagtttgccctggctaaactagttccttcttgtcattcagacatcaccttaaatgttactgttgagcaagatcttcccacaccacccactcttaagtggttcccaaggctcctttatctcctttttacattttattttctaatggcactacttgatatttttatatttttttgtctgtttgttgcctgtccccctactataatgaaaacttctttatgaaggcagtaaacctgtctgtaacgttctttattatacctagaagtttgcctgacacatactttaaatatggactcaatacatttttgcagcctaaaggcaatatagggaattggttttagaacataagttttggaaatcaggttaaaattctggctctctctgtgatcttgggctcctaatcaacttaggcaagtaccttaacttcactaagaccagtttattcatatgaaaaatgaggataaaaaatagaaccaacctcttaaggttatgaggattcaatgagatcagagtcatgtgagcattgtagtcaggacccagggacaggtaggtgcagatccacctctcaccatcaccactcaggaaacttcctacatctcagtttctcgatctgtattttacatctcttaccatctcatacagtaggaaaggatattaaatggtatgatgtacatacagcactcagcaccgggcctggcatgtgataactttgataagtatattcagttaacacttttgaaatataagacctgcacttttgatataggctaggaacacatgtacagtgtggttgaagtgtaagaacaaggacctgagagaccacaaaactaccttttaagagtagagtcatccagattcacccatgttgtcacaaatgacaggatttccttttttaaggctgaatactattccattggatatatacaccacattttctctatccattcatccattgatggacacttaggttgattccatatcttagctattgtaaataatgctgcagtgaacatggaagtgcagatatccctgcaccagattggtttcagttcctttggatacatactaggaaatgggactgctggatcatatgggagttctagttttagttttttgaggaatctctatatcattttttataaaggctgtactaatttagattcccaccaacaatgcacaggagatccccccctctctgcattcctgtcaacacttatctttcatttttttaaaaataaaagccactctaataggtgtgtggtgatatctcattgtggtttaatttgcattgccctaatgattaatgatactcagcattttttcatgaacttgatgatttgtatgtcttctttggaaaaatgcctgttcaggtcctttgcccattttttaatcaggttgttttctttctctttagttgtttgagttccttatatattttggatattaatcccttaacagatgtatggtttacaaatattttgtcccattctgtggattgtctcttcactttattaattgtttcttttgctgtgcagaagctttgatgcaatttgatttgtctatgtttgtttctatcacttgtgttttcagggtcatatgtgaacaattacaagactcatgtcatagagcttgatatggtttggctgtgtccccacccaaatctcatattggattgtagctcccataattcccacatgttgtgggagggactggtgggagataattgaatcacaggggcagtttcccccatactgttcttatggtactgaataagtctcacgagatctgatggttttataagggaaaagccctgttgcttggttctcattctctctcttgcctgccaccatgtgaggcatgccttttgccttgtgcaatgattgtgaggcctccctagccattggaactgtgagtccattaaacctctttttctttataaatttcccagtctcgggtatgtctttatcagcagcgtgaaaaaggactaagacagagctttttccctatgttttcttttagtagtgttacagcttcagagcttatatttaagtctttaatccattttgagttgatttttatatggtgtgagacaagggtccaattttatttttctgcatgtggatatccagttttctcaacaccatttgctgaagagactgtcctttccccattatgtgttcttggcacctctgtcaaaaagcaattgaccataaatgcatgggttcatttctgggctttccttactgttttgttggttaatgtgtctgtttttatgacagtaccgtgtggtttttattaaaatgtctttataatatgttttaaaatcaaggagtgtgatgctgccagctttcttccttttgttcaagattgctttatctatgtgggttctttgtggttccctacaaacttaaggattgtatttttgatttatgtgaaaaatgacattggaattttgataggggttgcattgaatctgtagatcactttgggtggtgtggacatttttacattaattctttcaatccatgaacatgggatatcattccatttatttgtgtcttctttattttctttcatcagtgttttatagttttcagtaaacaggtcttttaccttcttgatacaatttatacctaagtaattttttgttgctgttgcaaatgtgattattttcttaattttcttttcagatagttcattattagtatattagaaatgttactgatttatgtatgtcgatttcattttctgcaattttactgaattcccttaccagttctaacagttttttggtggacattatgctaagtaaaataacccaggcacagaaagacaaatactacatgatctcacttatatgtggactctaaaaaagttgaactcatagaagtagagagtagaatgatgattaccagaggatgggggatgggaaggaaggcaatggggagttgttgatcaaagggtacaaagtttcaggtagacagggagaataggttttgagatctattatacagcagaatgattatagtcaataataatatatatctcaaaataacttagagaagaaatgtcaaatgtctctccataaaaaagataggtaagtaaggtgatggatatgttcattagcttgatttaatcattgcacattgtatacatatatcaaaacatcatgctgtactccataaatgtatacaattataatttatcaatcaaaaataataatttttaaaaagagtagagtcagagaaaaccagggttccaacccagttctgcactatctgtcatctcaaggattgatttcctcaactataaatgataataataaaagctaccttagaattttgttgtattaaatgagataatgcatgaacattttcctctagctcaccaaagctcctggcacagtgcttgaaaaatatttcttgaccaatacatgatatggtacttagtattctatctaatacctagtaagcactcagttaacattcaccatagtttctgatattattattgtcattcttgtggagattgagaaaagtaaaagtgaaaattaccatttgtgattgacagatcaaggggaagcggtatactcttggctatagagataatactctttcaggaatacccagcttcagagagcagacattgctcagattactctacatctgattcatcctaaacttctctaggctgcgagagatcaaaccacggtataaacacaaggatctggaataggagagatgatatttctctaaaactagccaatactatacttatgactggaaaattcagtcgtggctaccactgtagcatctcatttcaactctgtgacccactagtcctggaatgaggcctaattatgcagtgtttgtgtgtctagatcagtctgatctctgttgactttcatttataccctcctccaataaataaataaatattagttcagaactgttctcttaccattttcttgagaaaacacattttaactgtaaccctgcaaagctgaaacctaattcaccttctctaggtccctaagcagactgtcgctaatgtttatccatttctttctttctttgttgtgtcatcaggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttcaacataaaatactgtgttcataatgtataatgtctaagccattaagtgtaatctatgcttattacctaaataaattatcacccatgctaattta

SEQ ID NO: 3 - DNA, 56346 bp, Homo sapiens
gcttataacctgggatgggcacccctgccagtcctgctctgccgcctgccaccgctgcccgagcccggtaaggagccctcggcccctctcgctgcccactccctagccgagagcacccgcttcccgggcccagaggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtgggggggctcccgattctctctccctctctcggactcgccgtctgtctccacctctatttctctgcgtaaaaccaggagtccagcccctctggggcttggacgtatcgctttccccgcagcctcagtttaccctggacagatgggcatggtggccctggctcccttccctgcagggggcggcagccacctggccctccccggtggggctggcggcctcgcggcggggtttcctgctggcctgggctgggctctgtgggaggggcagtgccaggaatattttctattcgggctgctgttgcctttggcccctgggcggctgcgccctccagggaggcagggtcattgtgaaagagaggaaactcctctcccaggcggccagggctgttcctgaggagggctggcctggcctcagtattcttctctgagaagtggagagtccactcccgagcagccgagtcaggctgcaggtctcagggcaggaacagacctgttctctccccaggggtagatcaagacctaggggacttgggctttgatcctcccgctcccagcaagcacaaacccagtgatggggagagctggtgaggccttggctcagcctccagattcccaagcttccttttcattttcttttctttctaaaaatttatcagagatgtggactcgtcatgttgcccaggctggcctcgagctcctgggctcaagcgaccctcctccctcgggcctcctaaactgctaggattacaggctcgagccacccaaagtgcctggcccccaagcttcagtctgttagagctggctggggctgagggctcaggaaacatttgcagatactgtgcggctgctaagggctctgtagactgttgggtgctgggcctgggtccaattgcacaataactgtgcctggggttaggttctgatgagagggagggagaagcagccacacggactgggaagcttggctaggagcaggaactggaggagtctccattccaaactccctctccctcccagaccccttaggcccaaggcctagggcggggaagtttgggggtgggggcgggaccctgtcctggcggggccatctgtgcaccatgctgagaagtaattctggttctgctctgtgggggtggatcaagtgaatgaatagtgactcctgcctgctgagcgcctggccggtgcgggggcagacacgtcgtgagagggaaggggaggccccactctcagcacagtctccattcctgagtgcttgggaagcaggcccagggccgcaggagccttggggtggagccaggcccaaaacagcctgctgcacaagcgcttccccctcccaacccgggcccatctcatctttggcctgctgggaggccagccaggtcaaccagatgcctcatctgagcactgactacacagtccctgaagtcagtggcttgcctgtgggcaccaggcacccatgtggaaagaggtaacttcgctggaattcagagtctaaggctctgatttctgatgtagctttgggcaaagttgatcttccagggcgtggctccctccccagacttggggtcgaccaggcacccataggcactttgatatgagtggaacgaatgaatgaatgtgcccttcgtccatcaccaaagacaaaccgagctcagctgagttagaatgtcagcgaggggttgcaggggaatcttccacggggcagtaggcctgagctatagcacacaggctctccagagaaatagtgggcaggttggccatgactcactggggggctggttttctggaaggtgtgtagagtgaaggggagatctgaggtctcctaggagccagggagtggaaggcctagtgcagggaagagcaagtggcctgcagtcaggctgggtttgaagccgctagcttgtgacctcggctggccgcttagcctctgcctcctcctttgtaaataggtggtaatggcagtctccaccttgagaggatgcacctgtgactgtgaacatagtagccgctcttgttgtcattccagctctgacgttttcaagtagcacgagttttccttagtgtcaagtgagcgcccaggctggcctgtttgctggaagctggacagatggctgtggctggggccacagagaatgccatcccaatgaaagccaggtggctctggtaccttgacgcgaggccaccttccctcctcccaggtgtctcttccggggaaggagggctggagggcagtgggcatttgccagggagctggagaaacctgccgtggccctttctgggggatgtggtgggggtggagctgggactaggggaggctgaattcagccaggatctgcctgccaggcgcagctcccaggaagaaagcccaatgtctgggagggtcagaacccagagggctgtcaggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgtggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatcattttcccaagcccatctgcccagctcatttctctgcatgcatacactggccccaacacccacacacgtgtgcatgcacacaggcacacatgtgcaagcccaaacacatcacacacatgcatgcacacacattgtgtactctcaggtacgcacccctgggtgcacacaggtgtgtgcgcgcgcacacacacacacacacacacactgtctcaggtacacacgccaggtccatgcattgcttcacactgcccagccccagaggctgaaggcctcagagcccacacctgcccagctacaacctggcaggcaggaggggctcactggtttcttttggtttatttaagacagagtttcactctgtcacccaggctggagtgtggtggcacgatcttggctcactgcaacctttacctcccaggttcaagcgattctcgtgcctcagcctcccaagtagctgggactacaggtgtgtgccgccacactcagctaatttttgtatttttagtagagacggggttttgccacgttggccaggctggtctggaactcctgacctcaagtgatccacccacctcggccgtccaaagtgctgggattacaggcatgaaccactgtgctcggccatgagagcatgtgtaggactccacagcttcagggcaccccagccctctttttgcggtgaggagctgacctccagagagtggaactagtagcattgttctaagtgcctgccacaggcatctgggagatggtccctgtttccatggagctcatagtgggggagagggcagttagaatacagcatgatggccggatgtagtggcccatgcctggaatcccagcactttgagaggctgaggcaggcagatcgcttaagtccaggagttcgagtccagcctgggcaatgtagtgaaaccccatctctacaaaaaatacaaaaattaggcaggtgtggtggcatgtgcctgtagtcccagctacttgggggtggtggcactgagctgggatgggaggatcccttgagcccaagaggtggaggctgtggtgagctgagattgcatcactgcactccagcctaggtgacagaatgagaccctgtctgaaaaaaaaaaaaaaaaaaaaaggatacagctctgatgggcaggaggcatggcgggtcactgaggcgatgcaggtgatccagctgtttctgtggagctgcccctccgtgtttctgtggagctgcctctcttggctccaggtgcctctgggaggaggcaggagcaggggtgactctcagagctgggtgaatcttgggccagcatcatcagatcacacttgcccaggacttcccttccttgagtctccagtggtggtcttgtacctatgagcagggggttaaggagccgagctgatctgagttggagtcctggctctgctgcctaccagtcaaacgagatgcagggcaagttcctcagcccaagcctcagttttcctgactctaaaatgaagagaaccccagatggaagggcttagcctaagacggacatgtctattcccttgattgtggtgttgatgtcacgggcgcatccgcacgccgaaacttgctaaattggacacaaaaaaatatgcgattatttttgtagttgatgaatgtgctgattgggtattctcgtgtgtgtgtgaggtgccaccctcaaactttgttatgatgttggcacattacccatctgatatttaaaaaatgcaatttatgatatgtcaagtagacctcaatagagctgttttaaaacatacaacagaatttcccgcaacccaaccacaccacccgcgccatcacacgcaaacaggggtaggcttccacatatttcctgaatgccttctggagcagggggcaggaggcaggaggcaggacaggtggctctggggctcctggacctcctctgctcagtgaggctgctcacaggagattgggcggctggaaagtaaggtttagggcctctgggatggcccaggctacctgcaggcagctgagtagctctgcttttgcagagtggttcactgcactgtgaaaacagattccagacgccgggaactcacgcctccaatcccaggtactgcccaccttaagtcctccctgcctgccttcctccctccttccctccatcctgcatggccaattgcctggctgcagttgccatggataccacctgctggctccagggttagggctggctgagtcaccagcaactcaggggcagggggttgaatgcccagtagggacgttgtgggcaccgaccagaaccatcttctctgccccagctgcatggtccatgaggtgtttccccttctaagtccaaagggcagcacaggcctgtgagccccggctgactggcaggtgggaccgtgcagcatgcacgggactgaattctcatgtgacggagctccaaagtccacctggctacacggccaggctctgcagcagaggacgggaggcctgggaaaggcacttcctctccccgagcttccaggcacacagagagtgctcaggatagcgatgcctgcatcactgcaatggtgatggccgggtgacccttctgggctccacttccccagtagtgtctaataaagaccctgggtgactctgaccttgtgacgttggtcagactccagtggaaacgttcccaggcagaacaaacatgccctgtacatttgggaaatgcgggatgctggggccaggtgtccacggaggctggaaccaggaggcctgggcccacatctgcccctgctgcttgttgatccgatgaccctgggcaggtgacctcgtctccctaaccctggtttcctgttcagcaaattggacacagtgaagacgcccaagcccagggccacaggaggcatgtgggggaggggggtgcagggcgagcccaagggcagcccaggattcagggagagccctcggggaagaagcatggctgcaaagatcaggagacaggaggccttggcgccttcgggaggcttcattgtgacggagggtggggcaggatgggagaccgcaggcacttcccggctgcagagggcctggctgcagagagccctcgtgcccatctgtccccccgggaagggccgctggttgcagaggtcttaggcctctgcctgtctatcgccttccctccctgggcctcagtttctctacctccacactgggggaagttggtctctgagcccctccaaactgggcattggcagagttgaattcagaggcgctcacatttggagacacgatgtctaaaattccagccagtgaaggttccatggggttgcaggtaggagagggactggggctgggcccctgccccacagcatccttctccacctgcaggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgaggtcagggttcccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcagcctgtctgctcaccgtcactcattcaagcctggcctcttctctcgaagcctgtcttgaactggaactaggaaaatagcttctcgttgtactgcctcactttctccatctgcaaattggccatccttgagatgccttccagagccaggtgatggaggcgcggggagggcacagaagtgaacttggcagtgctgctggcttagcctgcttgcagagaggcatgggctgggacctgctgccagccctgggaaggcacacagtcttcccatctccagagtatgctgtcagcctgcagtaattcagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactgaactcaaaccaacttacgcaaaaaggaaagggaaaagacaattcttggctcacacaactgagaactccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgggcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcatggcctttgactagggaggagagctggaggctaggaaggccctgacaagctaatctttgcactggctgagaaagagttttctggaaaagacagatgagtttcaggagaaccctagaccttccagcaatgacagcagatggttgtctcccagcagcctgtgtggccagggccaggctcagccaatgctccaacccatggaagccaccagccatcaccacgctacaatccagctcccaatctcacctcctggaagaatctcacctctccaggccttgggctttgtcctttttccttcttactgtgacttggccatggaatggaagctgtctctgtagcagggggtgggaggctgctgcatgcggatggtgtgaactcagggctccccccaggggctgacggagcctctccgcttctgcttctcaggccaacattggccagaaggaagacttcgaggaagccaggaagaaggcactgaagcttggggccaaaaaggtaccaggcgggaggcagggatttgggctgggagtggggcggtgatgtggagggcagtggtggatgctcctgccccagggatcccatcccttccagtgtgtcttcttgcttctaagagtatgagatcatcctgctctcaggtgtgtgaaccctcttgtttttctgcctcccccacgccctcttccacccacccaccttcccatccaggtggagtgtctcttccccacccacataccttcccttctcttttatctctctgtccatctatgcacccactcaccctcttttatctctgtttatctactcgtccacatatccatccatcattcatccctccattagctatccatcgatccatccatccatccattcagccatccatccatccatcacccacccatccattcacccatcatccatccatccatccatccatcacccacccatccattcacccatcatccatccatccatccattcatccattcatccatcatccatccacccatccatccatcacccatccactcatccacccatccattatccatccatccattcatccatccatccatcatccatctatccatctatccatccatcctccgtccattcatccatcatccatccatccattcacccatcatccatccatccatcatccatccattcatccatcatccatccatccatccattcacccatcatccattcatccagccatcatccgtctatccatccatcatccatttattcatccatcatccatccatccatccatcattcttcatccttccatgcatcatccattcatccatccatcatctacccatgcatccatccatcatccatccgtctattcatccatccattcatccatccatcatctatccatccatcccattatccattcacccatccatcccttcattatccatccatccatccacatatccatctgtcattaatccctccactgtctatccatccattcatccagacagccagccattcatctatccatcccccatccatccatccatccttcatccattcaccgtttttctatccatccattcatccatccatccatctgtcatccatcatccatccttctgtccatcatccccctacctgtccttccctcttttatctctctgtctacccattcttccattcattcaacagaatcagagaactccaattgagtctggtgccttgattgtgaatctaggcatgtggcaggcagacccctgtcccatacagggcatttatgatgaacagtgtcatcaggacccctgctcacatgtgctcactccccatggagaagcccttgccacttgtgccccttcatttgggagagtgagcaggggacatagcagggatgatgtgcaaggccaccagcccacctgcagggtcagagctgatcccctctgtggggtgcttctgcagggttgccagggtaattagcatgttaaaatgaacacgggagggagtggatgccccagtcccaagtcacctactggccacaggcctggaactagaatgtccctccttggttctgtgcctcccgagtgctggagagcagaggggttgtctgagcagtagtccaggaaggggagaaagagccctgagtgttgaagattcgagtgcgctttcagcagcgcaggagcaggctttgtgcacggcttcagcttttgtcctttattctagatgagcagttctcaaaacttgtggtcttgggaatcctctacactctaatttacgtggcgtttttaatgtttattttcttgcatataacattaggatgggccaggcacagtggctcacgcctgtaatcccagcactttggcaggctgaggcaggcagatcacctgaggtcaggagttcaagaccagcctggccaacatggtgaaaccctgtctctactaaaaatacaaaaattagctgggcgcgatggtgggtgcctgtaatcccagatgctcgggaggctgaggcaggagagtcgcttgaacccaggaggcggaggttgcagtaagctgaaatcacaccattgcactccatcctgggcaacaacagcaaaactctgtaaaaaaaaccaaccaaccaaccaaacaaacacaaaaacacatttatcctaatgttttttatatatccttagtcccaattgctttcttttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaacccggaaggcagaggttacagtgagccaagattgcacctctgcactccagtctggatgacagagagtccatctcaaaaaaataaaaattactgaaggccttagagagcttttgtggattacatctgttgatatttatcacattagaaataaaagctgaaatgttttaaatgaacagttcatgttaacataagtaacattacacttatgaaaaataactattttctcaaacaaaaaattttagttaagaatcttattggcttccatttttgcaaatctctgtaatgtctggcttgacagaaaacagatggactcttgtagcggttttctgcattcacttgttttttcgtttgtttgtttgtttttcttttttagcctcccagggcttcctcgctatgtgatgccttgttttattgaagtttatgaagaaaactgggcaacacagtgagatcccatctctacaaaaaataaaaaacttagccgggcgtggtagcacatgcccgtagtcccagctactcaagaggctgaggtgggaggattgcttgaacccaggaggttgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaatatctccagatacttccaaatgcctcccctactcccacccccaacagggacaaaaccgtctctggttgggaactactgctgtgagatcttaggtgacaactaagtttcatcttgttggggctgatttagaagccacatccagtttcacagaacggtgcatcaggattgattagcaggctggccgcggtggcttgtgcctgtaatcccagcactttgggaggccgaggcagctggatcacctgaggtcaggggttcaagaccaacctggccaacatggtgaaaccccgtctctaccaaaaatacaaaaattagcaagccatggtggcatgcgcctgtaatcccagctactcaagaggctgaggcaggggagttgcttgaacctgggagacggaggttgcagtgagttgagactgagccactgcactccaacctgggcaacagagcaagacttcgactcaaaaaaaaaaaaaaaaagagagctattgattagcaatgtctgccatgagtgcaggagggagagtaacagtgcagtgtgctgggattgatgaatgatgtctactacagatgcagaagaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcacccctcgagcggtttcctggtgtgcctccggggcagacttggtgcaaggcagctacatggctttgtttagaccccaatgagaggggtaacagctcgcccctgcgctctgtgcactgtggcacctgaacgcccattctgagtcctcacctccaccttctgctgtgggagcgatgtcaccccatttggcagacttgctgctgaggcctggggacattgtccaaggtcgcattggccaaggtcactgcgtgagtcccccaggggacacgcaggaaagtgttgaaaaccctgagttggcagagtagggttcaaaggcagctctgctgctggcttgccgtgtgtcctcagccagggcccttctccccttcctgaacctcagtttcttcatttgcaagatggggctcatgccatgtcttagtttcccagggcgagggtaacaaaatgtctcaaactggtggcttagaacacagaactgttctgcctcatggttctggaggcctgaggtccatagtgagggcatgggcagggccacgcagcctctgaaggtgccaggaagcctccggctcaggcctctctccagcttccagtggcctctggtgtcccttagcgtgtggctgcgtcactcctgtccttccgtcctccatcttcccaagctgtcttcttcctgtatctctgcattgtcttccctctgcttgtctgtttaccttccccttgctacaggaacccgtcttggattagggcccttcaatgacctcatcttaacttggttactttttgtgtgtgtgtgtgggggagagggacaaagtctcactctgacgcccaggctggagtgcagtggctcgatcttggctcactgcaacctctgcctcccagattgaagcaattctcctgcctcagcctcctgagtagctgggattacaggtgtgtaccccaccacacccggctaattttttgtatttttagtagagacggggtttcgccatgttgggcaggctggtcttgaactcctgacctcaaatgatccaccagccttggcctcccaaagcactgggattacaggcgtgggccaccatgcccagccttaacttggttatttctgttaagaccacatgaggccacattcggagggactggggttaggacttgaacccattattttgtggaaacacaaatcaacccatcccgtaccccttccctccgggccgtgtgtcccagtgcagactgcggggtccccgtggggtgcaagacaggaagccccctgcctgctgctcttcggaaggcagtccttgagaaaccagattcctgacaatgttggcaactgtcagccgatgtttttataaagacccaagtcatgagctctcagtcagcggacagcatgccaagagcctggtacaggaattgactgtttaccaaccccacagtcagaaggctcggaaactccccagtgacggggagctcactacctcgcctgcccgggctggtcagggtgctgatggtgggaagtcctggctcactgtgggaggtcctggctcactgtggtgcagggacacacacagctaagatgatgatggaggagacgcggttgatttgagggtggcctgggagacagccacccaccaggatggcacctgtcatgtctttgaaagtccaagtgttcatttcttcaccggagcactggttcagcaagcttgcactgggtatctgctgggagttgggtgcttgctggcattggcacagtgctaacttcttgggctcattgcgtaccttcagagagcccatttcctggcaagagaagagaaaatggatgtgtgatgaggaatgggagtggggccaggggtctgtgccagggaactgcgggagcagcaggcaggggctgaggatgagtctagaggagtgaataatggcatggaagagtgtgagaggcagagggaacagcctgtggaaaggcttagagccaagaggccctgaaggacagtctgtctggggctgtggagcaggagctattgctgtgggggaggcaatagggccaggactgggctgaggccatgctgggaggtttggcttcatcctgagggcaactgattagtgggtggaaggaggtctcaggttggatggaggtggccagtgactaccccagcgagatgctggggaagagacaggggagagcttctcacagactgcggccttggtttttactgtcactccagctgtggatgatgggatggtaggaaaccaggcaaggaggtttgggcgggcctgagctgttgggcaggaccgtgtgtatgctgccatctgtgcaaaggtggtggcagaggaggagaacccagaggatcaggactgggcgacacagcgagactctgtcccaaacaaaaaaaaaagctcccgacccatctgccttaatggaaagagctggatcgtgagcttcctatcccagaaggcatacaagccgagggcaggggatcagaattctgggaggggtcctgccctcaggtctttccaacggtaccattaaggttcagtagggcggcattcaggtctggtggagtgcatgggtgggtgggtgagtatgggtgggtcggctctggctcaggcagttcccgggtccatgcggagacccccaccccggaccagcccacatttagcctgcaacagcctcccgcagccgtgtgcgcccctcctccatgtggccaccagagggcgccagaggcttgggtttgaggccttgggggccgacaaaggcgggaggaggtggcggcaccaccggggtcctctgttccccatcctggacctgcagggcgtggttctgaggagaacgccccccaagctagtgctatggccgctcgggacttgggggcgtccctgcattcacactcagaagacccaacagggacggactccggggatgccggggagtaggtgctacctggcacagccacctctttcctggggttgacaggcaaggcgtacttctgcgcctcagtgtccctttatgacagtacccaggaaacccccaacagcctctggagacaatttccgagaactgggggtatgagtggagaaccaggaaggctgggagcgaggggaatccaaggccttggaggtgctggtccagccttcaggcatttaccccctgagtaaccacccagcaccaccatcccatgagtatccacccagcactgccccgggcgccatcacgggggacgggccaggtggaggctttcgggtctttgggctcagggaaggtgacagtgaaatgttggggggacaacggattggcctgggatgtgagggggaagggcatcctgtttgctggaaccgcctgagcccagccctgaaggcagaggcggaggcagcctcccttcccagcaccccgtccagacagcacctggtgcagaaattgagccgcactctcccctcccatgccctgctgccagccccacccctgcccacccagagagctgcaccgaagctggggtggcccttgcggggctcctctctccccctagttttggaagaggggcctggaaatatgattctgagactctagccggggagcgagagttttgtaaatggcaccatctgtatgggtgccccagggcagatgggagaccccaggccccccagtcccagtgggaccgtgtttacatgcatgtttacacacgtgtgcacaaatatcagcatgcggacactcgtgtgtgagacactacatcctccttctccccggaaagctgccaggagctgccctggtgctggggtcttggggttcagagggggaaggattagactggcctccttggctcttgcctgagacgagggcagagtttgaaccaaggaagcgtttgtttggcctcttcgagggtctctggctcctgaacagatgggtgtccgcatggcagcatctggatgggcagacagcagcccagccgtgcctggctggtgaggcacaagccgtctttgtgttggggaaacatgaagctgtgggggaaaatagctgggccatgcaacgtcggaccatgccttaccatctaaaatgaggctgtcttttagttgctccaggaacggggccggctgggggtcagcaggcaaatgtggccgcccccacctcagtgtcctcatccgtaagatgggactaatagaacctgcctcctggggctgctcaaaggattcagtgagttaattatgcatggagctcagctgggaagcctgagtgtgaaccgttaggatgagcgagtttgctgtgtggccctgggcaagtggctgcacctctctgagcttcactttcctcacccataaaatatggctaaaaatccccctggccctgggggcctctctgagtgacagcacatagtaggtgctcactaaaggggctgcatggagggtgagtgaggccagcccaaggcctgtgccgcacacacagctcccagctctgcagagaggctgaaccctggattctgtgccacctgacgagagtctggaaaatagcatgtaattcccaccgctgcctggctgcgcccatgcagttttcacagtaggcaaaaggtccctctgtcatttccacagcgcttaagtctccctctgggctgccgagcccacggggaagcaggagacgtgcgcggccattttctctctggggacagagctgggctggcggatgcctgcgctgaccccggcctcctcctcctcggcatcagtgtggacggtggtcccggctatgtcgggggtaacgttcacagctcagtggggtgttgaggtgtctccatttgcccacagaggatgcaggcgaggcaacctgcccgagggggtggctgtggtgctggggacctgggcttgggtcccgggcctgccctggctgtgtgtccttggactggttcctttcccttcctgggcctcagtttccctctctgtgcagagaagagctgaggagcaaaaggccctcagtggtcacctagttccacctcctccctgacaccagccattgaagagatgcggaaactgaggctcagagaggtgacagggttcccaaatgtatgggtatgggggagtccaagcaccctggtgccccagccctgaagtgagcttgatttggggcagggcagggtcagcaatgtgggggccttgaggaagagactatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacctgatggggaggagggcacagggttctgggagattccacaggacaggcacagaatctcctccgtggcaggggtgcccatcgggtggacagcctgctggggaggctcccttcgctggggccagctccaggggacacactttcttccccgccattcattcttcccggagaggctgtccaggtgctggggcacgggatagaaagtccctgccactcttcagccacatccctggcatcccaggtgtgggcaggcatggctctggcaccccaggtgcgggcagggatggctctggcaccccaggtgcgggtggggatggctctgaaacgtggttgctggtgtctgggatgctcagagccctccgagccccagtcagagcccccagctatgcctggctcctccccaggccacctgtgcctggtccccagcatctcttgagcctttcctggggtgggaatcaccaggatctcagggcctcaaccgccctggcccgtggcatgtcacccaggcaggagggcacctgtgggtattgcccagactgctactaccatccccacccctccagcttgaccttggacctggcctgcgtccatgcatgaatgatggacacgttccttccttcactcgctagctcatccttcatccagtgtctactgagcacccactcagctccaggggtgccgagtgcagggcccagggcagggccgagcagtgggagtttgaggcacactgccgctgcaagctgcccaatttttctagtagccatatatataatatataaatatttttatataatatgtattacatataaatacatatgttttatatatatatatatatatatattttttttttttctttttctggagactcgctctgtcacccaggctggagtgcagtggcacaatctcactgcaacctctgcctcccaagttcaagcaattctccctgactcagctcctgaataactgggactataggcatgcgccaccacacctggggtttcagcattttggccaggctggtcttgaactcctgacctcgtgatctgcccgccttgggctcccaaagtgctgggattacaggcgtgagccactgcacccggctgtagtagccatattaaaaaatagaaaaatgaaacaagtgacatgattttaataacatgttttaccgaaaccgatatatccaaaatattatcattcctcctataatcaatgtaaaaaaataattattaatgtttacattcttttttcttctgtgttgagtctgcaagacccagaatgtgctgcatgcaggcatgtctcgctagctggctggatttcaggtgctctgaatggccacccgtggcttgtggccacctgtgggcagcacaggccgggactgagctcttttgaggccgctttgggctcaagctctggaagagttgccccctcctaagcccccaaggggctcacaggagtttccattttgttctttctaagaggaatctctttccccgtccctttaaccagctggtagctcttgggatgcgtggcctggaggtgagccgtaatgagctctaatgatctgttttgaccccagacaccaggcagctcagtggctgggacagtagctgcttgttgacttgctgccagcgaggccgcaggacggggccctccctcggttcccacagcagcttgtggggccagggtgtccagtttcgaggtctttgtctgcagaggccaagcccaggcactgagatgggattggggcaggggccaagctgctccaggagctgggagtagggctgtggtcttcccatggctgctctgaggggctgaggaggtggcgggccccttccattgccctgcaccactgtcagctccacggcccagcagccaaatgacatctccacccccacacacacatgcccccgagtcctgctcagaggcaggggcctggtgagctccagggctgagtcgggggctctttttaccagctcaggccgaggggctcaaggggaatgagcttggtccctcagccaggctcagagtcttcccccacttctttcccttccacacccagagaagtgggtggggggcagcctatgcctctctgggcccccgaccacacgtggggccaggccagcagcggcagctctgtggactctccctgggtcacggcagtggccctgtggctgaaggtgctggcaaggaccatgaaccccgtctagttcaaactctcaggtctcatctggggagactgaggcccagggaacagggacccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgggcacgtccctgctgggggctgtctgagccagtggcctaggccgggactgaccccatgtgatgggggattgaacttccaccccagctgcctacacacgtggcctctgtcccctgggctgaccccacagaggtgtggtcatctgccagcccgttgccagggcggagccgctctgaggccatttcccagtcccccgagccagaggacacagggctcactctctctcctgctccctgggaggcggagaccagagccctgcttgccacctccgcagtgtgtgtgtcttggtgtgtgtcacttggggggatggctgggggatgtgatggccggccggggggatgtgatcgggagctgttctcccaattccctggatactaattgcccctagcgctttccccgggaacaggtaggcgctccaagggacagtcgcagacaaagccttttatggcaccagccctttttgaagtacaagttgcaataaaacatattagaagttttgcatcaagatccttagccgctccccagggcacctttctttttagcgactcgatggcagcccttgacaaacagcctcaatcaatcaggccggggaaaagcaactcagcgcacacaccagaaaattgctcaggtttttaaatagcagtcgccaaggctggctgtgagctctcgctgcagccaaggtgccgcgtggtaggggaggcggcagggacgcagccctgcccccgccgccagcaacccattaagacctggagtgctgggagggaagaccttctccaccatctgttgttttattattaagaggggagtttacaagagcaagcccatatgttgccaaacaaattgtcaaatagcagagctattaagggagccgggttggtgaggtttctcccctggtctccttgatgatatagaatatgaagcgtgtttcatctttaagaataatgaattggagcccccacccagctctaccctcacgcctcgagtcctggatagagaggggcagggccgacccatacgttgccctttctttccgttaagtccccagacaaaagcagcttctggtttttctagcatagatgagtctcaggagcacactgctgtccttccttctcaggttttgaggagaaggtgctgagctcagcttccatcccaaataaccttttgagccggaaaagtttgccagggaaagatgagcatggccccctcggccacctaccctctcctggagatgggtttcatcagaaatgactgtggggaatctgagcacgttctagaaggaggcagaggcagtgtttctgcacccaggaaatgtcagaatgactgagcagtgatgaggcctcctccaaaattctgagccaggcaggatctgagatggatgacacaaaaatcaatggggctttcaaaaatctctgctttcaagacgcttcggtagccaaggcaaaaaggcgccagaggactcataaaaaacatgcatttgcttcgctggccatcctctcccaacccatcgtccaacggaaaaacactcagaaccaccccatccttgtcactgtcaccataatttaaaaaaaaattttttttagagacagtgtctcactctgtcacccaggttggagtgcagtggcacaatcctagctcattgcagcctcaacctcctgggctcatctgaccctcctacctcagcctcctgagtagctggaactacaaacgtgccctagtacatctggctaatttttgtttttcatatatttatttatttatttttttacagacagggtctcaccatgttgcccaggctggtcttgaactcctgaactcaagtaatccaccctccttggcctccccaaagtattgggattgcaggtgtgagccaccacacccagctttggctaatttttaaatttttttttgtagagacagggtcttgctatactgcccagcctggctataattattatttttaaagccagactacaaggtgggagctagaaacaggatggtctcacgttgtctacatgttggagatcgttttgttttttctcctcaattacaatgagagtgtgaggggaggcacctcgggaccgagagaggctgggaaacacaaatctctttggtcttgggagggtcattgtcattggcccctgttgctttcctccccgccctttagcctctccttgctcctggacggaggtccgctgagaagggaggcaaaggttctttcacgccaccgcccaaaaacagaggctccacggagcctggccggctgctcttcttagcacccagctgctgagctgagtgaggagcgaggacggagcccagcaggccaccaggacatctctgctggagagtccagtcttgccttgcacagggtccgggtacccatgcctggccaagggcacagggcgagtgtgtgggctgaagagtcttcaaattctagagtagatcgtgggctgtgttttgtttttttaaatttcagttttcacgtgtaatatggtaactgttgatgagataatctacacaaactaaggctcttaggggcccttagtgattttttctttctcttcttttttttttcttttttgagatagagtctcactctgtcacccaagctggggtgcaatggcactatctcagctcactgcagcctctgcctcccaagttcaagtgatgctcctacctcagtctcccaagtagctgggactacaggcgcctgccaccatgccaggctaatttttgttatctttagtagagataaggttttaccatgttggccagactggtcttgaactcctgacctcaagtgagccactgcacctggccttgtaggctgttttaaaatgagtctcctggctttctagaaaaccccgaaaccagagcatttagcctcattttaatgttaaggtggtgatggggaaacagctgctccctgcaggaggcctctagaatctcaccatcttgggaatgagcctgagtggggtcgatcccatcaggagagagatgggagggtgacccggtgggggctgcctgtggttcccacagggatccagtggggctgaggggctgaaggggctcagaggcagagcatccagtctcgctggctctgaggggctgggtggggccccttcagtgcaccctgtgccctataagcttggggccaggagagcagtgccaggtgtccgagtgcaggaggaggctggagtgcacgagctggattccagtcgggcgtcatcaagggtggtgcgggtccccagggcgacaagcctcatcttcttcctcctcttaaggctgagtcaggtgggccttccatgcgtgacctgcagccctcttagcctgggcctcctgggcagaggtgggtgtcctcctgtaacaacagactgggccatttaggaagcgaaacagagccagagccgagtgccttggagacgggatctgctgggtgttccccttctagggtctgcagagtgatgtgtgtggctgttgcgccaggcccagggaggggtgcccccagaaggtgtgggccatgagctaaaagctctccctgcatcctacctgtcctggggtccacaggaagcactgcctgggctctggtgccaggtgccccggtccacagtgcgagcgggttcacacaagccccagctcgtagggtggtggcggggctggttggctggtgccgggagacctggctgggcatggcacctgcgtgcttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggacggccacgcgctgccccaggacgtcctggtgacccccacaccagtggtccctgccctcggggagctgagaggcctcaggcaggacagaggtcgaagcgcccggctcatgcactgccctcattgcagttctgctgagtgttgttggggagatagatcatggggacccggcctcatcaggagtatcaaggagggcttcttagaggaggtggcattcaaggatggagaagaggcccagatgtggcacaggggaagagtgtttaaggcagaggcagaggcccccccaaccacgtgcagagccccggggcagtccccagaagacaggtaaaggccccagctctttcttacaacctgcagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccatctcctcccagctggccacctttggtggtagcagctccatgccgatgctgtctgatgtatttatagcctaatttgaaatttcacgggggccagccgtggggctggggccgagccctgcctgtgttccccgacccccgcactggcccccctctgcccaccgtctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggtggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctggtttggaggcgggaaaagtgtgctttttgaggggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagggtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctacctgtggctgtgatgctggctggctctggccacaggcctcaccctgtttctcagcccaggttactacagcagctgggaaccagcataaggtggcggaaagagtccctgtgtttagcttccaaagcatggtttggagaagccacctctcagccttggctttccctgtggtccatagaggcatcaggctgggggtccctcagggcccctcctacctcctggagtctgtcttcagggaaggttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaatgaggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcaatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtctgcaaggtttttaaagcaaagatgagacagcagttcctggatgtcagcaggtgaacaaggaccccaggcacaggatgcccacaggagggacctgagcagtcaggcccaagaggccccagtccccacagtggcaaatgtccaagccacggcctgggggagctggggcctccgaaggtgggagggaatttcgagagtttcaggcaacacgcagcccctccaccactgcatcagacgagaggcccattttccaacacgcccaagaaaaaatatacataaaggttgatgtgttttcaaatgggtttttgctttgctcttctcttttctccctgtgagtattaaccttggggaccctggggacggctcggcttgccagagcacctgctggggtcacaggcagtcattagctttgcggtcagtgcagaataaaccccaatcccgagccggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggtatgtgcccacctgttgggactcgaagggggttgacttttggggccctggctcctttcccctccctgcctgggaacctaggccctctttacccccgccctgcattcctggaagctagagttcaggcaggggcttcaaggtaacgcacagcccacctccctggacagtacaacccatggaccatggatgcctctaggcttgggaggaacatgccctcggctacccatcactcgggttcatgggcaccaggtctggaatgagagcgctctagtccctgaacagccactcaactttcctgggcctcagtttcctcagctgtatctgaggatgaaagagtgcctgctgttttcctggggtagaatgaggcctgcaagggagcgtccagccctgggccctgaccccggaaggtgctcagtaaacggtgagtgttggcgagctggcctcatggacccctgggaccccacatggaaagccttcgccagtcttcattgagccgctctgggcctcaccctgctgaccccacgttcaaagctgcggccactcttgctcccctcggcagtggaggctgtcctgatcgctccctccttctcactgctgtcaacaagaagcgtttgctgacctggcctgagtgcctgggtgcctgagcttgggagagggcatctcttggcctggaggaaggatggagaagcgaggcatgcccgcctgggctcagagggagggctcagagggcgggctcagagggcctgaaggggtaccttttcaggaggctggagtgatcagggaggcttcctggaggaggtggtgctgggcacaggggcacccaaggaccaggcggggggctggcccattcgtccacaaagtggctgcccacactggagctgggatgagagggagagaggctcgtggagaggcctggcccggctctggcgctcggctcttaccccggctaccacagaaaggaggatagggtggggaagcctcaggccggtggggaggcagagctgcagatccccctctcccccttgctggtgtgaccttgacagccagcttcaccatgctgggccttgggtgcactcatcaaaaaacggaccacaggcatgatgctcacaggtgcccggcatggtatgtggaatggggtgtcggaggctaagtgctttaataatctgcctcttctgggcctttcccaagagcttggccaagccagcgactgtcttccttgctccccttcatctgtcccaacctactggggggccaaagaggaccccaaaggcagccgggcccccaggcctgtttgcaggcacagagcctccctttaggatcatctctgagaagatggtgggagtggccccagcagcacctcctggctccctgcacagggctcccaggagcctggagagccgtgagggtgggaggcgggtggcaggctgcggagggtcctgggcaccaggctctggcagccctgcccgaggaccagggcagctccgcaggctgagctggagaagaaacgtgacctattgtcatgatttggggactgtctggaagaagaaaaaaagaccggaggaaccctcccctggctagtgcccattcactctctagttaatttatttgaagttttaatctaattattaactattttaaaggctaagaggctttctccagcagcagcaccaacaatgtcacctcttctcccgggcaggccccatctaaggccccagcgaaggccgataataggaccggggagggagagaaagggagagaggagaggcggggggtggtgagaggggcttaaggttcattattgggcagacttacatttaatagcaatttacaaccaagttataaaacccctggaaatgggggttaagaatggcgaggctgacagcgccttgagtgaagcccctccaagcggcgcctggctaataaagcctcgaaagccgctattgaggcctgattggcacccgatggctcgctccatggtaatgagccgggcagatgggtgggggattagccgccaactttgaacagcttttctttgtcactgtttcagctctcttgttagccccaatacatttattgctcatttcacaccgctcgagaaagtgccccttgctattcaaagtcaaccccgaacccacccactgcccccacccaaccccttccctcctgccaccccggacccagctcctcggattcagggacgctgccgacacctcgcctgctggagcgggcaccgtgtcacccccatcaatcagatggctgcgtgtgggtctggggtacagggtcggggcgcggggtccgcctgacagacgtggcagggggctgtgtgtgtgtgtgtgtgtgtgtgagcgagtatgtgtgtgcttgagcccagccacacctcggccaggcggcccccgggtgactggtgggacagaaggtgctcccggcgtaagacaatggtggagcgtgaaattcaattagttcagggcctggttccaatttcacagcccctaaatgcaaaaggggcaaagagaatgggagggtgggggagagcgtttttattgcattttctctttcattctggggggctttctcgccccttctctccctgcagcaggcctcaacctgcacagggcttttgaaggagtcatttggagtccatatctgtcacatccatttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccggggctctcaggcccttggctggatgggaggccaggatagaaggaaagggagcagtagttagctgtggcgctaggcagggccccaggacacagggaacggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcgggacccagcaaacccagagatccctgagaccctgtcccctttggacgctactacccccatgctccgtgggcgaccttgggcacgtcctttcaccacaccccgtgagaccgcagtttccctcctgccaagtggggatcgtgggccctttgcccctgactttcagggtgttatgagaagagctgtccaagggctgggagaggcccaggagggcctggggagtctccgaggagcagggaggccagggccaggcctggaggtcaggctgtcttgtgtctggggtgggcaggccgggtgtggaggcagaccgtgcaggcccgatttcgtggtcattaaggccgcatggaggccgccggccaggcagggcgaaaatcctgccaggggtgggcgctgtggctgcacaggcactgggagccggccagggcctaaggacctgtcccagcatcaggcacggctcactggcccttttctccagggatggggctgtgccacagttggggctgtgccgcagttgaggctgagcttcagtgtgacatgcctgccacctcggctggcctctagcctgcctagcctcgtatccgcctgtggctgggcccaggagcagggcagttggtccccaagcaggtgcctctgtcttctcttagtagccaaagcccatgattccctttgtcagccaatcagcatttcatcttgaccacaaccctcctctccaggactcagtttccccattcatacaccaaggggatctcagctccctgagggtctgccagtgtgtgataaagccatgctgtgttctttcttgggggtcctaagagggaaagagcaaggtttcagcagttgcagcccctgaattgggcacctgaatttttatactggtggtggggtcagggcttcctgtttcggtaaatgttcaggtctctttgcttagggttgatttgaaaagataccacaaccaaatatcacctggccacggtatagtcacggccccatgtctctcaggctatttttactaagattctaaaatccaaagagagccgatcaccccatgtgggccagaagaaaagggtggtggtccggagggcaggatgcctgcttctggtctcaggtttgccctgccttgcccaacaaccttggacttgtcatctatcgctaggcctcagtttccccaagtgtaatgcggtaggcgctgggagttgcatcactctggctctgacctgtctgcgtttccctggaaaggcatggcagcatggaccggggcggggacgggcttgcctcgaaagacatgggagcgcggaaggggaggcaggctcgcctctttcttgtggctttagctccttgcttgctgttattcaggagaaacaacctaattgaagctctggggaggccttgagaacaatgttactaattagctgctcctttttatccgggcttacctttgtctcttacctatattaacatgtgattagatgcccctttgtcgcagcctgcccttgggagccagcgcggtgtgcaccctccagggagagctgggagggaccttgaggagccacagaccagcaccccatttacagatgcggaagccagggctggggaggggtgggatagagggcttgcttcaagtcccaggcactttagtggcaggaccaggactgccatctgggcccagagtggcatggagtggagggctaacagcttagactggagttggacagatctgggttcaaactcatgtatggtggcaggaactggtacactggaagtgctccataaatagccatcagtcccccgggcatgtggaatggggacagaagcagcccccatcctctgggagctgtcagtgtggcggggggtggggtgggttccagtattgcacctgtcttatcataataagggcctgccacaggcatgcccttgccatgcctgtggcaggcatcaccagtcaatgctggcattatcctgttgactccagaggtatctcagggctgcttgcaggcactaccaaatgatcaggattggcatacgtgatgaaagtgtattgccttccctattggaaagataaggactggcctgaagtcactgtgaaatggcatcctgtggggtggggcgagtcaagcagagttgagcaaaaatgaactgaaggaggtggttagtgatgaaaacctggaatgcactattctgaatgtggaatggtagctgacagcattccacggaggctggacctttttcccagaatgggggcctcatccccgtagaaggtcaaagccatgagatcaacagtctgttccaatccccgtggctccttaccacccacctggggaaagcttcctggagcccagccttcactctgccctggtactttgtgtgtgctgttggaggctctccccaaaagcacagaatttagtcagtgtcgtacagggaagaaaatcgggattctgacggcaagaacttgctgtgtgatcttaggcaagtttctccctctggaactccaattgtcaaggggccagatgaggaggtcgtatcatctccctctgaatgtcctcactcacctattttcttgctttgggttggggagagaagacaaagttgctaggtaattttagggtggtgtcttgtttttatttctctactccaaatatttcatgtgagaaggaaagaggagagacggtaaattagggcactgtggattcccccatgacaaggtttttattaagtgtacagtaatgagagaagctgttaatcgtcaattatattgagggcagaacagaaagatgctattgtccgtatctcggtgtacaaggggaacatgtcatttgtattgattttacaaagctcgtaattgaaattcgttaagggctgatttttttctctggggggcgggggcgggtagggagttgggcagcgccagtgccctgggtctggggtggcctagtcagcggcgctcagggtcagggacagggggctggggaagccgcggctggagtagctttctccgtattgtggctgttcacatgtcattatcacattatctttttaactctggaggggggctaattaagtgaagtaaatgaaatcagtggggaggagaaggggggcaaggcaggccggagggaagccgagggaggccgggaaggagccagcgcatgtccttgtgctcagcctctttctctgtctcctctctggccccagacttctcccgccgctctcccctctccgctctcctcccagccctgcccgtctcacctctgcctgcccccgccttgctcctcctccttgccttcctttcctcctccctctctccctttcctcctccctctctccctttcctcctccttcccctcttccctcccttgcccttccctctttgcacatcctcctccccattccccactctcccctcctgtctcccttcctccttactcctccactttctggcccagaaggaacaagggctgtcacccacttgcccaacgtgcccacccaccatctggaacattccagatggagaatggagggagacctgtgaagcaaaaaggttttcagccccagaggcccacccaggatggggcccgccaggcaccaggagcatagaggatggctagagtcccaccctgactggcctcccatcaccatggcaactgcttctcaccttggccctggtacctaagaggggagcccttgggctccagccaacccctatgccccacctcttccaaatcacttcttctactttcccaaaggaccagagcctttagtccaggtgccctcacctccagcccaggccccagctgagctggcggatcccactcaattctgcaaaattgctcattctgcctaacctggcagcctcagggacagatgagaagaatttgggccacagtagctgtttggttcccacctctttctgcttggtccactctccccccagccacccctggccacccctagatccttgcccgtctccccactccccgctgcacctttcttggcagtaattatggtgtgattgaagctgctccacagagaactgctgacacctctgtctttttcctgtaaacacggggagatgaaaatagacacttggagctgctgtgtgtgtcactccaaagatgtccgttgtctcttccacggcaacacagaggctcagctgtcatttcctccttctctctgcgcagtggtttgtatgccgactgtcaaaagccccaaattcatagtcttttagcatcaggtttctgtcactgttttttttttccagaagaaacacacagaaatcatctgtaccccctacccctgtggagaggagagggaagagctttaaacgcacacacacacacacacacacacacacacacgtgcgcgcgcgcgcgtcggcagcaacctaaaaacaagttttttgatccgtcacaattaacactttcgaagaaaaggagcaggaatattaattgcactggtgtgttttgtggctgcagcctttccccttgcccgtgagccctccggaggctgcctgggagggtggcagccaggaagccggtgctgggggctcaggaagaggagggttctgcctggcctctgcccaccagacattctctgctcccggtggcactggcctcattttcctggggacacctgtgatgggccagtagctggaggaccttggacaagtcacagctcttcctcgagccctgaaccccacctgcgccctcccctctctggactgatgggaggcgatgctgtggcctcgaatgttctcgagacaagactgtcagtaagtagggcacacctggaggacgctctgaacacttacctttgaggtaggtcccaaaggaagttggaatgtcagagcagcaggaacttgcagccttcttgttttccagatgggttgcctgggtctaagagagggggctgagaccggccaaagtcacacagcaaagccaagctgggcaccttctgtaaaggccaagctgggcactttctgtaaagcatggttgtaggactcctggtgcccagctccagccctgcaaatgtagtttggactgccctacagttggccgagctgaggacagaaaagcagggaggcgggcctgggtgtctaggagttgaaaatgaggagggctcctgctaccggcctacccaggatggcgccattacgactctgtggccagtgtaaggatgggctttgcaagtttctggaattttccaaaatgtacccaaactaatcactagaaggcctgtttccaacccgatatgtatccagttctagcatgtgccaggatggaggaccagcaggactttgtcagtgtcgtgctcttgggaaattgctttatttctggtaataaggtttctaggctgattgaaaatttgctcctcgaactttatcgttatatctgccattttggagacagagatttcctgtttctgcacacactggtctttctggacacactgctgaaccattcccctttctggtggcttttttggcactgtcatgtttgtgtgcggtcatcatgttttgttttgtttctctttcagacagggtcttgttctgtcaccgaggctgtagtgcagtggtacgatcatgactcactgcagcctcaacctcctgggctccagcaatcctcccacctagcatacaccaccacacccagctaatttaccatttttttgtagagacggggtctccctatattgcctgggttggtcttgaactcctgggctgaaacgatcctcccaccttggcgtagtagctaggaccacgggcacatgccaccacgcccagctaatttttttaattttttggtagagatggggtctcactatattgcccaggctggtcttggactcagctcaagcaatcctccctccttggcctcccaaagttctgggattacaggtgtgagcccccgcatacctggcctgtgctaagttctatgtccctgttctccaggctgtctataatgacttttctcagtcattcctctgtttctgctgccatcagcctttttaccccttcctggtttgtggctctgagctactctgcagaaaatgatgacggacccatttgaactgttttacaagagtcacggtgaggcctgaggaactcccgagggatttgagggcttggatctctgcataaacttggagagaggccatttcctaatcagaggtcacaactagattcagacggtggacatgccgaaggctgcagcccccaccaatgaagcgggatgggctctttcacagcacacgatactcatatttgcacctggttgctctgaggggctttcacaagcatgtcacctgacaccagtatatcaggggtttacagatgagagaaccaagcccccagagaggttcccttctgcccaggaacacggagccatggtgagaaccaagcttttcctccacagcaacagcctggacttgggctttttctctcacgctctggttagcagttgatcactttgccaaaggcccttcgaggccacctggagctgagatgggagaccccggggccgggcccattccccctccagttggctgggtggtattaggcaagccacccccctccccaggcctcaggttctcatttgtaaaactggtgtgtgggactagatttaaggtgagtccagagtttgcagaggggcctctgttcctcccagcacaacctctgccatctcttctatatgctgggcttctgccgcaggctgtttgaatattaggttggcagctaacagtcgggagaacacggtaccggattgatcctaatgcaagctctgacatttccgtgattctaagacttaaagatcaaagactggaggagttctccaaggaggaaacttctggttagtgcacgagggctcagcagactcagcctccccagatccccggtaggcttcagagtcaaaaccaatatccttcatggtttttttttttttttaatttaaaactgtggtaaaatacatgtaacataaaatgaaccattttaaaatgcgtaagcgtgccgctcaacggcattaggtcctttcccagggctgtgccactgtgactaccgtccacctccagaacattttctttttgcaaagctgagactctggccccatgaaactccccattttccctaccccggcccctggcagccaccatttctggctgtatgattttgatgactcgagggacctcgcatgagtggaacatacagtgtttgtttttgtgcctggcctttgtcacttagcgtcacggccttatgttgatgctgtggcatgtgtcaggatttccttccttttttttttttagacagagtcttgctttgtcacccaggctggagtgcagtggtgtgaaatcagctcactgcaacctctgcctcccaggctccagtgatcctcctgcctcagcctcccaagtagctggggctacaggcatgtaccaccatgcccggctaaatttttttgttatttttagtagagacggggtttcaccatgttggccaggctggtcttgaactcctgacctgaggtgatccacctgcctcggcctcccaaagtgctagaattattacagtcatgagccactgtgcccggcccccttccttcttaaggctgaataatattccatcgtatggatggactgcattttgcttcttcactcatccctcgatggacacctgggttgcttccgcctcttggctattgtgattaatgctgctatgaacatgagtgtacaaatcctttctgggtttttttcaagcagccactgtagaaagatgttagtaaattcccaggataactgagaacctgcccttttagtgatgtaacgtatggtggaagaaaggaagctctcggggtagaatccatggagatgggggagctatggcccctgctccacccagacagcagctgcagggcaggcttgcccaagggccagctctgaagttgatgcgagaggtcgcactcctggggcaagagggggcctgggctgtgtgctgtgggcggtcctgcctcttggtgccccactgtcctccaatgcagtaggaccttcccccagacccagctcagcccaagaccaggcatttctgtctcactcggagatcatctgttccaagcaggttgttttccaaatggagggactgggcctgaggtcacaagaggggacttgagcaatcccttctcccctgaccttccagggttgggcctccacggccaggtgacttacagggcagcagacagcactggtgagggactcgggggcctacattcagttcccagctccacctagagcaagtcccttctcctcttgagctcagtttccccatctgcacggtgcggtcagcctaggtgattgcccaagccctctgccaccccagtggcctctggagagacctggccgcaggggccccatgggctgaaggtggcatgtgtgtacacatgtgtacatgtatgtgcacagctgtccccctcccctggctccctggtggaagggaagaagggatatttggggctctgggctctaccgtagtcgctttaattacaggctttcaacctcgggccggtgggcacgcatggggagggaggggttgctgctccgaaaccctgtcattttctagcgtctgagggccccttcaaagggggcatctagacattttctccacaagccgcagagtggactgtcgtggccccagcatgaacataatgacagatgcattttgcagcaagctgggagtgaatgggtccggccggcttgtctcctgtcagacgactcattattattattatttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgagggagcaaggggatgctagaacctgccttgccatggggtgtgtccagggagatgcaccggcttcccaaggtgtccggcagcttccaccccctacagtttgcatgactgcagcaatgccaggcactgggcactgtgcggcgacatgcatcaccccgcatggtcctcacaactttcccaggaggtctgcagctccttgtacacgaggaaactgaggctcagaaggaaagcataaaaccagaagtggcctagctgggtttgacccccaagtcaggctgtctccaggaagaacctggacctactccatgaacttgagggagaggctccctggaccaggaactcagccccagaccccagtaccgcaggagccagatcttgaccatgaaaccactggggtggccacagggcctgagccctgtcacacacccagcccatgtgtggaaggaccggtgggtgacagcacctgaggcgggggtgtccccgttttgcaggtgaggagcccgggtttccatgccttggaatccaggcctcctgactccaaaatccaaccctcatgtggtgtaacagaggtccccaaactacagtccctgggtcaaatccagcccgtcacctgtttttgttcagctcatgagctaagaatagtttttacatttttattttatttatttatttatttatttatttgggacggactttcgctcttgttgcccaggctggagtgcaatggtgcgatcttggctcactgcaacctccgcctccctggttcaagcgattctcctgcctgagcctgctgagtgactgggattacaggcatgcgccaccatgcctggctagtttttgtatttttagtagagatggggtttcaccatgttggccaggctggtctcgaactcctgatctcaggtgatccgcccgtcttggcctcccaaagtgctaggattacaggcatgagccactctgtctggccagtttttacatttttaaatggttgggaggaaaaaaaattttttaatgctatttcatgacaaattatataaaattcaagtgttgccgggcacggtggctcatgccaggtgaggtggctgtttctgcattgtctgtggctcccctggagcggcaaggggaggttgagccatttgagagagaccataggacccaaagagcctaaaatattgactctctggcccttcccacccacctccataacatacacatagccctgatttggggcgttacattaaacagctgccctgagctgtgggaggacaggctgctgcctgaggccgatcctcacatcttcgggggcctggacgtcaggggacctgtgcaaagttagtattagttaatcgaatagctacctgggctaagctctcctcccctcgcctctccccctccactcccagattttgtttccttttaagcctcctaatcactgtaactcatctcaggatttcgagagggctcgatggttattggctggcgttatttctccctgccattgttccttgcagctttgaagccaagtttctgcccccgttcccagggacagacaggtgcttaaataccattgtctcctgcaggctttccagcccggcgggattgcgaccccgaaaggaggattttagttacaaagtgagagagtcattaagacgtggcggaggagagagcacctggccgggctgctccggggcctccacggaggctgatcccaccgtggccgcggccacggctgccacttatcctgccatcttgctgctaggctctgagctgggcacctgatggggtattatctaatattagctgcgcagaggtgaggaaacggaggcccccaggtgaagacactcacccaggctctcctggctggtgatgggcagctttgagccggggacaggccagctgtagcggccaagttcccagttactccaacagattccaggatgctcgtgatcaaggggcacggcggcacagacaggggaaccctgggtgtagggcacagtttggctcctggctgcggtcacgatgcctctacactggactggctgggttgagtccctgctctgacagccagcgacaagccctctacatcccaaactgaggtacaatgattaggagacttaaaaggaaacaaaatctcagagtggaggcgagggagagtaggggcttcttctgggtagttatcactaatattaactttgccctggtccgctgacatgcagggccccacaaacatcaagatcggcctcgggcagcaggctgacccccacagctcagagggcctgtttgatgcgattttccccatgagggatacagacatggtatagaccagggctttgcctgatcatgttacttaacttccctaggcctcagttttcccatctgaagagtgggaataacagttctacctgtctggtgggtgaggactaaaagtatgagtatttgtaaagcacctggaacaatgtctggcagacgagtgcttattccagtgcgtgaaataactgcgagcgcccggcgtggtttcccagtgtggaggcgcggcacttggagtcttgcctctggctgggttaatggtcttgagcagggctgtctcttccttgagcctcagtttcccctcctgtcaaataaagggcaccaggctgagggcacgccagggtctcttcccagtcccgtctagctcctgggtggaaagcccaccattctgctgtaatgcttggcttcctcagagcccttgtggtctcggcacagatagggagactgaggcacagggaagccctcctgccccagcctcactcctagaggccctaggttctgtgaccactgccactctgcatctgtgtgtctgtgtgtggctggctggctccctctcctctcccaccattcccaaatttcctggtctggctgtgtgagcttcaggcagactgtctccaggagtggcaaccagggttagcctggcaggaccccagcttcaggaccctggcagggcccagaggagcatctcatctagggggtatagctcacttcttctcccctcacctccatttcttcagcaataaaatgggtataatgtgcaactcacacagaattgctccagttagaaaggatcgcatgtgtttggctgggcctagcagcacgggggaggggtccctctccagctcagccctaagccccacccacagtgatctgcaggtctggggggtgcagggtctcccccattgcagcttatgccaggctcactggcccccaacccaggctgggtccgctgggaaaagaaatctgagcagaagaaccctgtggggcagaggtagaaaattctgagataaagcccaggccagttgctcccacagagatctctgtcctatctctggctccatctcctgcctgtcttccggcctggaaacttaatgggctaattatcccagctccgtcagaaagatggccaagcccaggacaccagggcatggggggctgggagaacatcagtggccccctccacgagggtctcggggtgtgttggaaaaagccctgggccagagttaggagtgcttcatcagacctgggctcttccaaagtcttgctgtgtggccttggacaggctctttccctctctgggcctctctccctgtgtacagtgagggctggcacagagcatcatgttcaaactgcaaatgcaaaacgctttgcgctctgtgcattccctcactgcatccacacaacctctggttagcaatgttttctcactgtgcaaatgaggaaaccgaggcacagggaggttaatcacttgtccaggtgtggctgggatgcggactcacagggtgggacactggagagcaaggactcaacctctactctccgtgcttggccctcccccgcctctgcaagccccaggaccccatcccagaagcctgtcccctttcccacggaggacctctgcaggtgcccccaggggcctgggcctcccacaatagccgcagcccctgggctgacccagccctttatcagggcaggagatcatgcgccatctggccctgcagctgcccaggtgggctcaccttccaggctccatttcaggaaactctagccttgccctgtccctccccccgccatggcctgcctgcctgcctgcctgcctgccccttggtcccagcctccatcagcagaggctagagagaggccgggggcagactggggtctgagcgctacccctccctggcctttagggctctcggggagaggggagggagcatgtttctcaggcacctcctgcccccacctacacaccaagggatgttctggccatagagaaagctccaagtttatcataggaagcagagttgttacaacttgggccaacacaagtcaaatggaggctccccacttccggcctgtgtgatcctggagaagtttcttaacttctctgagcctcccttcctcacccagaaaggggagaggctaagagagtttctctcagagtgctgtctatgaggattcagggagctagcccagatcaaagcctgagcgcagtgctgcttatctatgcagaaatattctatctgcccaggaaaacagcagcaggtgcagaaaacagctcactgattccaaggggtgggctctggccaggactccagttcacagtagcccctaaggctggtgctgctcagtgctaggggctccacatgaaatattactgtgacatccccactcaacagatggggaaacagaggcacagagaggggaaggctatgcatggccatggtctgaaccaccacccagctgcctgcactggacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatggcatgaagcagtgggtcacttccctcctcctgacccttagggaaatgacctaggtggtcacctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgggcacagagcctatcttttgactggatcctcaagacatctgtgcctgagcacatgtcaggcaccatgcagagcacagagtgatggtcacagaggatatagacaccactatgctcccgtggaacttacaggctagctgggagaaaggcatggatcaaaccattaccagaatgtagaattagacaaggtggcagcgggctgtgaggaatgcaggatagtctggctgggtataataactgggattggctaggaggggtggtgcatgcctgtaatttcagctactcaggaggccgaggtgggaagattgcttgagcccaggagttcaagaccagcctaggcaacatagaaagaccttgtctcaaaaaaatatatatacacacacacatacatatatatatatatatacacatacatatacacacacacacacacacacacacacacatatatatataaaataattggggttgtgaagaagctcctttgctattcaaacaatagcagaaggagttaacaggtgaatggggggaggggtggaagggcaaaagtggccagggggaaggagctgaagctagatcttaaagggaagggcaagatcagatctgtgcatttagagggtcctcctggctgctctggagaacggatttgagtaggtgggaggtggaagggcacctgtggaaatgcggtagcttggaccatgctgatgattcctggactagatagcagcaggcgaatgtgacacatatctaggaggagggattgaaatgacttggatgtggagggagatggagggtccagaatcaccctggtgtctggggtcgtgagcagctgggtgcagtccctgggttgaggaaatgctcttgaggaaggatcatgcatttggatttaggtgtcatgagtatgggtttcttttgagatagctgggaaaaactaactggaaggccgccggacacttgggtctagagttgaggagaacccaggctgaagaccctggagcatcataggcattttgatgttctctgaagcgctgggccaagagagactgcctaggggaaagcgtggagtgagacaagaagggaactagccaggcaagatggtgcacacctgtaatcccaactctttgggaggccaaggcaggaggatcgcttgaggccaggagttcaagaccagcctgggcaacatagtgagacctcatctctactaaaaataaaaaaattagctaagcgtggtggcatgtgctcgtggtcccaactacttgggaggctgaggtgggagcgtctcttgagtctgtgagatcaagggcgcattgagccatgatcatgccactgcactccagcctgggcaacacagcaaaaccctgtctcaaaaaataaatacataaagtattagccaggtgtggtggcatgcacctgtagtcccagctactcaggaggctgaggcaggaggatcacttgagcccaggagctggaggctgcagtgagccaggattgcaccgctgcactctaaccttagtaacaaagctaggcactgtctctttaaaaaaaaaaaaaaaaaaaaaaaaggaaacacaactggaaccatgagatttctcattgatggaccaggcagaaggtggccaaggaggagcccctggaggggcaggagggccctggtgagccagggcaaaggtggcaggtaacgattggccactcctgtgtccgccccgtggatgagagtgacctgcaccaagggacgaggtgtcacctccagaggtcacctggccaaactagagatggggcaggcccctgtgggacagacagcccccactagacgtgggtcccctaaggcccagcttagctcaggctaaggccagcccctccctcctggaggctggttgggaattaaagtacgagtcttgtttggcagtcaatattatttttttctttcccttctccttgccatgttgagtttctccccgcttcaatctttctaaacactttataagccataaatacaactgagtcagtttagatcagttggggtaaatgtcaaattatcttctctctttctctctctggctctttcttccctccccctccaaatcaacagcctctaataatctgtccaacccttcattaagccttacagtctcactcagggagattaaatgaataaagtaaaaagggaaaggggaaaaaagagagaaaagcaggagcatttattctcactgtgtctccgaccatttcccttttctttttgatttctacatcgctgacttgaaagcccttgagtgacagcgtcacagggaccagcgaggaagccgtgagaggtagcagagctggaaatgccgtggctcagtaggtagaaagtaacgtaattatagagcaggtcagagccactcgaatgagcaaaaataaaagcacagaggttttctgtagaccgtcaggggaggtaaaaaaaaaaaaagaaaaaaatcattgtaaactctttttccacctccccgctcacttcaaaccacaattttaaaaagaggttttttagttcctgagaaacccctcttggaactcccagcagcctcgtgggacaagtttgtccctggatgtgggccctctttgcaggggctgccagggcagctgggaagttcccaccttggggaacgggatggggagagtttgttgtgacttgtgagagatggaggtgaagggacagatggacacagaggtggggggattctgtgtcctacgttctccctgggctgagtataggggccagtggggctgaggctcggtttctaaaacaaggtctgttgaagggatctgaggaggttggtggtctagtttggtctagctcttcctaagcactgactgcacagaaaggggtggccagcaaaagtctggtatctcctcctcttccagggaatgcaagctcctagtggcttcagtgcctgagccctggaggggccgtggaggtgtggaggagggaggaagggacatcaaggaggtacaggagcatgggagtgactctgcagagagttccacgcacccaccggcttcaaggcctggtgaaggtcagggcccgggtcctgaacaaatcactggggccaggcagatgcagagacctcatttgttcttgtaaaaagtccactgtctacaaagaaccagtcagagggccagcctcagggtctcaaagcagcagatcctcctgcctcccaacaccgacccccgctacccctacctcgagaaccttgagtcagctttgtcccaaggctggaattctgcagacaagggtctgattcagagcaggacatgacaagggaccccatcctctcagaggctcagaggctggccttgtggagtaggaggcatctgagtccacgtgccctaagtgcttagcacaaccataattaatgaaggcaatgggtgattgattgcttcggtctggcccctccctgtggacaccactcttgctcttccttccttggcacctggcccagcatctggcaggcagcaagggcttaataaatgcctgaacaaatgaatgagtgaatgaatactgttagtactagtgggtgctcaccatgtgccaggcaccagctacattatttcatgtggggccaaatgtgacactgagagctaaccaccatcacgcatttcacaagtgcaaggctgaggctccgagtgcaggaatactggcctgggctctctggtggcgggtggcggaaacaggacgcaaaccccagtcagctggctggagtgactgccatggttaggaaggttgggaggagcagctaagggtggagagccccaaagcagaaggctggtgagtctgagaggtggaaactgtagagaggtaaaatctgctctgctgagtacagcagcagtcaacccagcattttccatgacacactggcagtgggtgcccaggtttcaggatggattaggtaaggtctaactggttggacacatgaggggaaaggtgacttggtgggcccatctcgctgtgaatgctggaggcctccctgcagcttgcgaaatgcccttgtgctattgcaattcacaccccaaggcctcctgagccttcaggtcactgcatgccatccacacagtcccaagggcacagctggcttggacgagttacccatttacagacagagtgctctggttggtggaattcatagggctagttctggggtggctgctcctagcctcctgccacattgtgtagcagggaagaggctgctgtgtgctccactagggctctccaacctttgggtgggtgcctggcccagaacagggttccctgagttgtacagaaattcaatggaaagccgacgtgcagggagggtttggacccacacaggggaaatgccctggcatctgggaggtggggctgcttctggccccagcagtcctcccttcaagcagaggccagggccaggctgagctgacaagcttctactctccttgcagcatgaacgtgcagggtgattatgagccaactgatgccaccgggttcatcaacatcaattccctcaggtgagaagctcagggccctgacgggccttcagagcctccaggtgtaaagggtaggctttgagagcccccaggtgtaaagggtaggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcctgtgtcccaccgggtgcctctgatacttgccctcccctcccgctaagccacagggactccactatgagctcctttgcagggcaggttaaacaaggaaatagcatagaggtggagagaagcctttgttttctgtcaccatacctgagctgtaggtctagctggaagccatcctagccacgtggatctccatggcccaggagggtggtgcacgtcatctgaagtcactcagacctttgatcctctgtgagtcaccagtaagagtgtcagctgtacctgcctcacagatgcagtgaaggttcaatatgagcctgtggaaatcaagcatgcggctcaggcttagaccctggcatgcaggaagagccaggggcagtgccagcagcaagcacactcagcccagggccggtgtgctcaagggcaaacagggtcgtttgtcaccagcagctaacatagactaagctgctctgggacactctcctaggatgtctcatttaattcttacacaaaatttgcaactccccgggaacaggctgagtggttaagtaactttccaagggtcacacagctaggaggtggtggagctgagtccggagggcctgtcctgctgtgggttctccatcaccagctcccttctcatggggattggagtctagaagaagatgcaagtcagtctcctcttgctaacaacatgccctgggcacagagccatcattttctcccagagccagtctcttgtccctggaggcacctcatgccccgagagatgttgaagcccgcccatctgcccagggtcctctcccttcccctccgtcacctccacctcccctgcctcctgcgccctctgtttgtattttatgactctataaacccttttaaatggcccagaacaaacagggcttacatagtggcctcttcatttctcctattgccagttaaacgctttgtcttcaacaatgacaaacaatgttttccccctaagataaattaattacattatcctgattggagggcaggaggggccagggcgggagagggaatagaaaaaaaggcaacttcacacacatcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttcta

SEQ ID NO: 4 - DNA, 17761 bp, Homo sapiens
ccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtgagtgggacctcggggactccggtcctcctagcctccaaaggagagagtgggggcgccagacctgcctcgggccaccctgctgggaatcgccctccaggaagcaattttgaaaattacctaggaagcctgcacccccagccctcccgggcgcatcatctggagcccagcagtcacctttaccaggactcaccagtatccgcaggcagcccttgtggcaaacccaccaacccacactactaggggtagagtggctctgccctcacctcacagtgatgcctgcctggccaggaaaagtggctcccaagccttcagccttccaactcttccttccttcttaccacgtgtcctcctgtcaggtcccaccccacaccacatcccttctcctgctagagcaattgtccctgtttatagaataaagctcagcccctaagtgttcttgtccttgactgtggcatgtggaaagagccaggaaaaaggggacgtcgcctcgtggctccagcaaccctggtgcctggtcccttcctgtctcactggaccctgcctcttagggtcagtggctcctggcctctcctcctgaccactgagatgctggattcccaggcagaggttttccttccttgggccatagttgatttatctggcaatgggggtaataatagctgtcggcctcactctgtaaggcactagattatgaggccattgctttggacccttcaggtgagaggggctgttcgcctgatgcttgatgaagggaactccgggaagcaggaggtctgggttccaggcccttttggccttcattagctagcaattcacttcctctttctcaatgccctgcaagctcagtgccctgcaagcttctgggtcatggcaggggggtagggcctggactttggagccaaacagacttggtttctgtaccagtcacttgagccctttaaacctctttcctcatttgtgaaataggggtaatattgcccacctcataaaaggccgtaataacatatgtgaaatccctagcacagggctgagcaacagtaggtgctcaataaatggtggctaaccacaacaatactgatatttctactttgggaggccgaggcgggaggactgctgaagcccaggaattccagaccagccagggcaatgtaatgagaccctgtctctacaaaaagattttgaaaattacccaggtgtggtggcgtacacctgtagtctcacaggaggcggaggcatgaggattgcttgagcccaggagtttgagactgcagtgagcatgatctcaccactgcactccagcccaggcaacagagtgagatccagtttcaaaaaaataaaaataaaaaaacctggcaggcatggtggctcacacctgtaatcccagcactttgggaggtcgaggtgggcagatcacctgaggtcaggagtttgagaccagcctggccaacatggtgaaaccccgtctctactaaaaatgcaaaaattagctgggtgtagtggtgggtgcctgtagtcccagctattcgggaggctgaggcaggagaatcgcttgaactcgggaggcggaggttgcagtgagctgagatcgcaccactgcactccagcctgggcgacaaagcaagactccacctcaaaaaaagaaaaaaaacccacaagtcccaaaaccaaaactggtatttcccatgtacattcgaccttaactgttgctcattcaacccagcccaactcagtgccccatcccctggccctgaagagaccattctggcccagatgtgtcctggcttggagtagcaccttctgctaccacactaggcctccactctcctcagtgcccaaggggaggcacctcactctgatctccctgtggggtcctcttatgcctgccagtaaggataggagtttggttctagagcagagtggtctggcttccaacaagcccagtgttctaggtgacctcaggttgccccaggccttcctgtaggttggcactaattggtttggctgcagctccacttattaagtagttatttttattactaacaacctaggcagggtggcccaggagcccgctgggggaggcggtgccaggctcctggctgaggggcaggctggccccaattctgactggctggctccagtgatcaggaccagggccccacgtggtgctttgctggagatctaggcttggtggggcagctgtggggtaaggggcaggaccagctcaaagatggggtgggggcggaggctgcctctgcagggcagagtcctttggcagtcgggactgttgggcatagaggagtcagctcacagctcagggccagagcactggagaggtctctggggtgcatacaggaaccaggagtggagctgaagcatgtcctatcccctgccagccctcccttagtaacagctggcatttctcgagtccttcctgagcaccaggcaccgtgttatgtatgcaatttgcaaatattatctgattaaatgctcacaataaggctatcagagaggtactattattatccttatcttattattattattattattatttttaagaaggagtcttgctctgtcgcccaagctggagtacaatggcgccatctctgctcaccgcaacctctacctccaggattcaagtgattctcctgcttcagactcccaagtggctgggactacagcttcctgccaccgcgcctggctaatgtttatatttttagtacagatgaggtttcaccatgttggccaggctgatctcgaactcctgacctcaagcgatccacctgcctgggcctcccaaccctgagggtttttgtttttgtttttgttttgagacagagtcttgctctgtcgcccaggctggagtgcagtggcacgatctcagctcactgcaagctccgcctcccgggttcacgccattctcctgcctcagcctcccaagtagctgggactacaggcgcccaacacccccatgcctggctaatttttttgtgtgtgttttcagtagagacggagtttcaccatgttagccaggatggtctccatctcctgacctcgtgatctgcccacctcagcctcccaaagtgctaggattataggtgtgagccaccacgcccagcccctgaggtttaataataggtgccaggccaggtggttaatagaagtctggggcattgtagggggacagaggaggatatatgtccccattggccattgtagactcccttccacaaaaaggacgtcagtgaagtgacatgcccacctctaccccaccctcctcccagtcctgggcactagggctgctccccaggtgttctgtaccccctccccactctgtcccatgccctggcctctgccctctttcaaaacatagatgtggctggcgcctaggctcatgcctataatctcagcactttgggaagctgaggctggaggacagcttgagcccaggaattcaagaccagcctgggcaacatagtgagaccctgtctctaccaattattttattttattttattttgttcatttatttatttattttgagacagagttttgctctgtcacctaggctggagtgcagtggcgtgatcttggctcactgcaacctccgcctcccgggttcaagcgattctcctgcctcagcctcctaagtagctggaactacaggcgagtgccaccacgcctggctaatttttgtatttttagtagagaccaggtttcaccatgttgaccaggatggtctctgtctcctgacctcatgatccacccaccttagccttccaaaatgctgggattacaggcatgagccaccactcccagtcctataaaattttaaaaaaatgtctgggtgtggtggcgcatgcttgtagtcccaactattggggaggctgaggcaagaggattggttgagaccaggagtttgaggctgcagtgagctatgatggtgccaccgcactccaacctgggtaacaaagtgagaccctgtgtctaaaaaagaatttaaaggccgggtgtggtggctcacacccgtaatcccaggactttgggaggccgaggtgggcagatcacgaggtcagattaagaccatcctggctaacaaggtgaaaccacgtctctactgaaaaaaaaaaatacaaaaaattagccaggcatggtggtgggcacctgtagtcccagctactcaggaggctgaggcaggagaatggcgtgaatctgggaggtggagcttgcagtgagccaagatcctgccactgcactccagcctgggtgacaaagagagactccatctcaaaaaaaaaaaaaaaaaaaaagaattaaaaaagatttttttaatgaacaaaacaggctcggcacagtggctcatgcctgtaatcccaagcacttcgggatgccaaggtcaggggatcacctgagatcaggagttcgagaccagcctgaccaacatggtgaaaccccgtctctactaaaaatataaaactcagccaggtgtggtggcacacgcctgaaattccagctactcgggaggctgaggcaggaaaattggcttgaagccgggaggtggaggttgcagtgagccgagatcacgccactgcactccagcctaggcaacagagtgagactctatctcaaagaaaacgaacaaaacatagatgcctacataccattcctctgcccttggctcctggggagtaagggatcacccagtgacctcctagaaggccagtgacaatggggggtgtcagggtgcttttcagagccaagggagtggtaggaattgggatcttagtccagctccaagctgtgagggagagagttgcagggcacttaagcttggtggagaccctcaaggcctctttgcctgtccctgcagcaaaggttctggacaccagagccaagtccagaagccctggtggaacaggggtgaaaagcataggttctgacttcagactgctgggccgcagccctggctatcccaccccaggtgagagcaggctgctctgtgcctcagtttccccatcttcatagtggaattgtattggtgcctacccagagggttgtgtcaacaattaggatggcacctagcaccttggtcagtggtgggaaaggttccagaagttctgctgtggtcccaggggtgtctcaggccctgccatcatctccttggaggggtgccatgtggtgggaaagaaccccaacttcaaggccacacacagtggctcatgcctgtaatcctagcactttcagaggccaagatgggaggatcacctgaggtcaggagttcaagaccagcctggccaacatggtgaaaccccatctctactaatgatacaaaaattagctgggtgtggtggcacgtgcctgtaatcccagctacttgggagtctgaggcaggagaatctcttgaacctgggaggcagagtttgcagtgagctgagatggcaccactgtactccagcctggccgacaaagtgagactctgtctcaaaaaaaaaaaaaaagaacccaaacttttggtgttcagccatgttcccatgctcactcccagggtggtgactctgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtacttgccgtggcccaagccccacccaaggccccttccctgtggccccaggctcccaccaaatccctgagcaaacagtgcagtgttgcccatctgtggtttcacattgaactaattatatactcaagtgctgtttaactgtgtgccttgatgactgcctctctccatcctttaatgacccctgtggcccacatggctcatgggtaaaggtgtgctgggcctgagatgccccctcccagggtgcgcttccaggactcagctcctgggcagggacagtcagtcaccagggatagggtgggaccaaggcaggggctctcttggctgctgatgcctgctcacctgaccccggcattgctgctacccactacaggtggctgaggagtgggcccagggcaccttcaaactgaactccaatgatgaggacatccacacagccaatgagcgccgcctgaaggtacgacccctggagccccaccgctttccttgcctcccctctccaccttgcccagggccactttgagcattagcaccattctgtttacttcgccattggcagacagcatgtgagacctcaggacatgagccaggcaccctggctcatgcctataatcctagcactttgggaggctgaggtgggaggattgcttgagaccaggagttcgagaccagcctgggcaacataatgaggtcccacagctacaaaaattaaaaaaagaaaagaaaaaaagaacaggcctcagcagaaatggcgagagatttggggaggacccggagccctggggtatggaggtaggttggcagggctgatgaggaaaactgccctgcctgggttgactcctctgggggtatagaccgtgaccctgggtctcccttcacctccaggagctcattggtgcaacggcagggaagctgcacacgggacggagccggaatgaccaggtgctttagcccctccaccccctgctccgtgttgtcccaaccttgaggagcccagggggcagttagagttctgcagcggtcctggctcctcagggaagcaacacatcggcctccctgagcaccatctcctccttgcacaggtggtcacagacctcaggctgtggatgcggcagacctgctccacgctctcgggcctcctctgggagctcattaggaccatggtggatcgggcagaggcgtgagtcctacagggacacccagggggcagacagaggtgtgatggaagcctgaacaggagacctagggggcaggggtgaacagcgtgggggtgccaggccctgggggacaggggcatcccagaactccaggatcgaggcagagcagccaggagtgggccatttcctgcaggccccaatactcccatgccagtctagctcagcaggcagagaagactaacccttcgtggggctgggtgcggtggctcacgcctgtaatctcagcactttgggaggccgaggtgggtggatcacctgaggtcaggagttcgagaccagcctggccaacatgggaaaactctgtctctactaaaaatacaaaaattaggcaatgtggtggtgtgcgcctgtaatcccagctactcgggagcctgaggcagaagaactgcttgaacccgggaggaggaggttgcaatgagccgagatcgcgccattgcactccagcctgggctacagagcgagactcctgtctcaaaaaaaaagaaaaaaaaaaaagaaaactcaccatttgcagatttgaaggcaggaagctaagccaagcacagctagcttggctgtgcctggagcagccagagtcactccccacactgcctgtcccccagatcccccatcctaagcttcgcctccccatccagcccatctggcaaaagacagagccaaaggctgcctcctgctggcctcatttcaggctttggcttctgggacctggtgtctttgggactggatttgttccttgcagacctggacgaagagctgctgagaagtctccatgtgttgtcagagacccctcctcttcctcaactccctgtgacccctgttgtgcagacttgggggaaaacaagggcacaagaattgtcacccagcaggtggtgtggggctgctaggaggaacagggagtgtctgctactgagttcagggtttctttaattttttgttgttgttgtttgttgttgtttttttttttttgagacagggttttgctctgtcacctagtctggagtgtagtggcgctatctgagctaactgcaaactctgcctcctgggttcaagtgattctagtgcctcagcctcccaagtagctgagattacaggtgtgcaccaccatgtccagctaatttttgtatttttttcagtagagatgggttttgccatgttgaccaggctggtcttgaactcctgagctcaggtgatctgcccgcgtcggcctgccaaagtgctaggattacacccataagccactgcgctcagcttaatttttaaatttttaactttttaaattgtctttagagatgagatcctgctctgtcacctaggctggagtgcaatggcttggtaatagctcactgcagtctcaaactcctggactcaaatgatcctcccacctcagctttctgagtagctaggaccacaggtgtgcaccacctgtgagacagagtcttgctctgttgcccaggctggagtgcagtggcgtgatctccactcactgcaacctctgcctcccaggttcacgccattctcctgcctcagcctcccgagtagctgggagtacaggtgcccaccaccacgcccggctaattttttgtatttttagtagagacggggtttcaccatgttagccaggatggtctcaatctcccgacctcatgatccacccacctcggactctcaaagtgctgggattacaggtgtgagccaccgtgcccagccgcgaattctttaaattttttgtagaaacagggtctcactatgtggctcaggctggtctcaaactcccggccttaagtgatccttccctcttggcctcccaaagtgctgggattaaagacttgagccaccgtgcctggccttgagtacagaatttcttcatggggtgatgaaaatgttctaaaattggttgtggtgatggttgtacagtaaagtgtaaactttaaatgagtaaattgtgaatgatatctcagtaaagctggtttatttaaaacaacaggccaggtgctgtggctcacgcctgtaatcccagcactttggaaggctgaggcgggtgaatcacctgaggtcaagagttcgagaccagcctggccaacatggtgaaaccccatctctactaaaaatacacaaaattagctgggtgtgatggtgggcacctgtagtcccagctacttgggaggcaggagaatctcttggacctgggaggtggaggttgtagtgagccgagatcacgccactgcattccagcctgggcaacaagagcgaaactctttctcaaaaacaacaacaacaaaaaaacaggccaggtatggtggctcatatctgtaatcccagccctttgggaggccaaggcaggaggactgcctgaaaccaggagtttcagaccactctgggcaacatagcaagaccccatctttttttttttttttgagacggagtctcgctctgtcgcccaggctgaagtgcaatggtgcaatctcaactcactgcaagctctgcctcctgggttcatgccattctcctgcctcagccctcctgagtagctggaactacaggcgcccaccactacgcccggctaattttttgtatttttagtatagatggggtttcaccgtgttagccaggatggtctcgatctcctgaccttgtgatctgcccgcctcggcctcccaaagtgctgggattacaggcgtgagttaccgcgcctggccacaagaccccatctttacaaaaaactaaaaattagctgggcatggtggcatgtccctttagtcccagctactcaggaggctgagacaggaggatcgcttgagcccaggagatcgaggcagcagtgagctatgatcatgccactgcactccagtctgggcaacagaacgagaccttgtctctaaaaataaaaacaaaacaaaacaacaagaaaacaggaccatcactcacagcacctctgcctctgccctgcctacttgaatgaggtgcagggcatctcacctgctcagagcagcccttgaatgagccccagctatttctagggtcctcaaacgaaacctcccacggccaagtcatacccaacatgggcctcctcccctattctggcccctgctcggagatgctgagtgacagaggctggacttggggtgtttctggcaaagcctcactgcaggaagccccacagctcaggcccagtccttggttcacacggtcccacttccagcttcttttgcccttaagactgatttgtccctgggagatcaccagatccctcattcaggtggagtgctgcagcgtgacactttttccaggggtgacccaggcctgcagggttccagtgtcacaggcaggccttgcatgagcctccacccgagcttctgctcctcctctcccacagggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaataaaataaaataaaataaaaataaataggccaggcatggtggctcacgcccgtaatcctagcactttgggagtccgaggcaggtggatcacatgaggtcaggagtttaagaccagcctggccaacatggtgaaaccccatctctactaaaagcacaaaaattagctgggcatggtggtgcatgcctgtaatcccagctactcgggaggctaaggaaggagattcgctggaacctgggaggtagaggttgcagtgagccaagattgtgccactgtactccagcctgtgcattgggagcgagactccatctcaataaataaataaataaataaatggataaattgtatgtgagtgataactcagtaaagctggtttatttaaaacaacaacaataacaaaaaacacgctaggtgcaatggcttacgtttgtaatcctagcactttgggaggccaaagcagaaggattgcttgagcccacaagtttcagaacagcttgggcgacatagcacgaccccatctttgcgaaaaatgaaaatttagccgggtccccccaccgcctaacctcctcctgccccctgtatggtcaggctgggtggggatgggagaggcctggtgactgggaaccttttctcccagccgagttcctgttctgggcttcgctgtgcatgacccatctcagcaggatggccgaggacctcatcctctactgcaccaaggaattcagcttcgtgcagctctcagatgcctacaggtaagccctgaactgccacctccatctgccgctgccggcctctgtatcccccgccgcccgcggacgtggctgccttcctccccgtcccacccctccgccagacctggccattgcggcgctggaccagccaagggtccagccccttcagcgccagcacctctgtccccagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcagtgtgccgggctcctgatgaccctcaagggacttcccagcacctacaacaaagacttacaggtgcgaggccgggggaggcctggctagtacgtgccagttctcagggctctggcacactcaggcagggccccaccccgggattgccatacatcctcccatcctgtgcacacagctccatccgtggctgcccttgaactctctgcccttcctttgttggggtattgagtgttcttcccatggaaggcagtggggatgcctcagtgggggggtggggctgtggggaccctgggtgccagggggctgctaggccctcacctcctgccatgtgcctcccaggaggacaaggaagctgtgtttgaagtgtcagacactatgagtgccgtgctccaggtggccactggcgtcatctctacgctgcaggcaagacatcacccccctgcttctcctcccctaggtcccaggcactggggtgggcatgcggggagggtggccttgggaggaggtgaggtggggctggaggacctggggcagggaaggagaggtgtgctcgctcctgctcctggggaacagggaaaggacagaaactgctgccatgcagtggaagtagatgagactcagggggcctggggcctgtcaaatggcctgaccagaactctttaaaaaaagaaaatctaaacaaaaggccaggtgcagtggctcatgcctggaatctcacactttgggaggccgaggcagatggagcacttgaggtcaggggtttgagaccagcctggccaacatggcgtaaccacgtctctactaaaaatacaaaaattagccaggcgtgatggcccacacctgtaatcccagctactcaggaggcggaggcagaagaatagcttgaacccaggagatggaagttgtagtgagccaagatcatgccgctgcactccagcctggaccacagagtaaaactccatctacaaatatataaattaaattaaattaaattaaatatctttaaaaaacattttttagagacagggtcactctctgtcgcccaggctggagtgcagtggtgcggtcgtagctcactgcagcctcaaactcttgggctcaagtgatcttcccacctcagtctccagagtagctgggactacaaacatgcgccaccacgcctggctaatttttttattttttgtagagacagggtctccctatgtttcccaggctggtctcaaattcctggccccaagccatcctcccaccttggtctcccaaggtgctgggattataggcatgagccactttgcctggctgatttcttttaaaatcaattattatgggaaatttatgtatataacagctagagaatgcataatgaaccctatgtaccgacacccagcttcaatgataatcaactcacggacatcctggctccagctgtctttacccacagctctctcccactcccttacccccttattttgaagcaaattcccatcatcacatcatttcattcctaaatagttcaggatatgtcttgaaatcagtgtttcttggctgggtgcagagcctcatgcctgtaatcccatcaatttgcgagactaaggtgggcagatcactcgaggtcaggagttcgagaccagcctggccaacatggcgaaaccccgtctttactaaaaatataaaaattagctgggtgtggtggtacacgcctgtaatcccagctactcaggaggctgaggcaggagaattgcttgaacccgggagatggagactgcagtgagcagagatcacgccactgcgctccagcctgtgtgacagtgcaagactccatctcaaaaaaaaaaaaaaaaaaaaaaggcagtgtttctggaggctagtcccccaactagcagcaccagcatcacctcagaagtcctgagaaatgtgatgtgaggccccactccagatggctgaatcagagactctgggggtgctccccagcaatttgtatttttcttagtaaattctccagtggctaggcctggtggctcatgcttgtaatcccagcactttgagaagctgaggcaggagaagcgcttgagcccaggagttcaaaaccagcctgagcaacatagcgagaccttgtctgtaaaattaaaaaaattaaattagccagtcgtgatggcgtgtacctgtggtcccagccacttaggagactgatgtgggaggatcccttgagcccaggagctcaaggatgcagagagccaggattgtgccattgcactccaacatgggcgaccctgtctcaaaaaagcccaaaacaacaacaacaaattagctaggcacggtggtgtgcatggctgtagtcccagctacttgggaggctgaggctggaagatcccttgagtccaggctgcagagggctataatggccactgcactccagcctggacaacagagcaagaccctgtctcctaaaacagaaaacaaatcctccaggaacatctgatgcatgctgaagataaggactctttgaaaacataaaggccagtaaaacatacaggccagtaagtgttcatagcacatgtaaatattatcgataattatgagaagatggttcaagttgagagtgagacagagccgagtgggtaagagagtatctgcccaaggcagggatgtcctggcagaggggcaggtcctgggcctggcagcttcagatcccagggtccccagggctcaccactcgcccacctgtgcccccagattcaccaagagaacatgggacaggctctcagccccgacatgctggccactgaccttgcctattacctggtccgcaaaggggtaagtgtgtagcagccagggggagggtgaggagatggggtgccccccccagagggtgggggagctcaggaatgggtgcaagcggcccagcctggtggctcacccctgtaatcccagcactttgggaagccgaggtgggcgggtcacttgaggccaggagttcgagaccagcctggtcaacatggtgaaaccccgtctcttttgatgtaaaaatacaacaattagctgggtgtggtggcacactcctgtaatcccagttactcgggaggctgaggcaggagaattgattgaactgggaggtggagtttgcggtgaggtgagatcgcgccactgcactccagcctgggcaacagagcgagactttgtgtcaaaaagaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaatggaagcggagaaaactgggcaagggcaatgagagtcgtagacgggaagggaagagggggctcccatcatagcctctgctctgtccaggccccatccccttcagacagggtatcacagtgacctcctaggccaggagcgatggctcacgcctgtaatcctagcattttgggaggcctgggcaacaggaagactccaactaccatattaaaaaaaa

SEQ ID NO: 5 - DNA, 4518 bp, Homo sapiens
cctgtccggaccccgccccgaccaggtccagccccgcccaacggcaagttaagagccccccagtgccagacgctccagacagactgccactcttggggggcaagagttggttgtcgtcatggcgacggcgctgatggctgtggttctgcgggcagctgctgtagccccgaggctgagaggccggggaggcactgggggcgcccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtgagcggagcccggcgtgggccgtgacgcagcgaggggatggggttgtgcggccacctgtcctcaggcatggcaggatacgctgcgggctctgcgcagcggaagcgggaaggagcccggcagggcccagaccagcgccgccgggaatgggagaggccgtaagctcctccggaagcctcccgcccagcccgagtgaggatcctgggggaccccacccgccaggtgtgatgctctgaagaaggcccccaacatgggcgcagttaggggttcagaaggacctggacaggagccgcttgcactgcccctcccccaaagatgtcccggagtccaaggtcggagggaggagggcgggaggtaccccagcgtgagacaagggagtggcaagacccaacggggcaaagggcggagcaggtgggcactggtggccagaactgggtcctgacagcttctggaagggtagggtcaccgagacggccctgcaggccaggctgtgggagccagcggctcaggtccgtgtcacgctccttgaaagcccactcctccgcaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgcccaggcgtcctcagagcgtgctactctgcccgccctgccccgtccggcaggcctggagggggccctctcgagcaccacgtctggcccacagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtgcggccctttctttcaccttcccccacgccggcgatccgggccttctcttgcgcccctcgcacttctccccgacgggccgcagactcactagcaagccgggtgggtagaaaagcctaagggagtataggggaggagttcagccctgggtgcccagatctgcgccctccctggctaaggactccgggcggaagtaaggataaaggggtcagagaaaagagaggtccgtgggggtaggggggcagtccgtgccggctgtgggccaggctcacccgctgactccggacacaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaagggtgagggcggtgggcgggccggggactgggtcccgggagtgagtactggccggggctgggtgtctgcggtcaggaggagcggcttctcctcctgtccaggagccgtagggggaggcggggggtgtcacagcaatggctcctgctgctgccgaaacccgggggaggtgagagaggaggagacccagtgtactggaagggaactccgaaggaattaaaggaatgggcgggactaggggggagaaggaggggccccccggtgggcggggccaggggcgggaccataagggaggtgttcgaccgggagagatgggcggggcttaggtgggtgggccgggtcagcggcgggagacagacttcaaggagcgaggcaagactaacggaagtgggtggggctccaggcgacaggaggaacttggggcacaatctctgcctggggaaagcatctccttgaatgaaaatcacagacaaatctatgcagaccactgaaatcatttcactgtggaggtctcccaaagacggaaattgtcccaccagcgcctgtcctacctgcagtccccaccaggctgcgcaaacggccctccagccagactagcccctccccatcctcctccagggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtaagcctgcggaccccagagggcggggtctggggggcagtcgggcagcttcggaccaaggagaggtcccagcctgccgctctcccgctgcgccaggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtaggtcctgccactcccagctctgggctgggccctgacttccctcccctctcccacccttgccaaccatgccaagaaggctgggcttcctcttcttccactggtctccctttcactacctcccaggggcagaacacacagaaagcctgagatttcccgagttaaagcatgcttaacactccttttctggcagcaagtgacacctcctaagccccacgcagcccacctctcacaggggcctgaggaatcctaacccttcagggtctattggaggcctgcggcgcctccagtggaacatccctcctctctccttcagtaactaccccctcacccctacaccctgctctgtgagcactaggaagtgagcaagaaccctcctctttgctgcacagccaaggcagtgtggagagcaaagcacccgctcccttcctgtgtgcgcctggcaaggtacctaacttctctgagccttagctgcttctctgtgagctgagcatcacaatgccaggctcaggcctctgctgtgaggataaaatgagataacacacagcaggaccaagctgggtgcccagcatgcagtaggtcctcaatcaatgttttttaaagacagaaccagtgagtaatgaacactggccttgccctaaaaactgtttcctacatcacctccccacacccaggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccctcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaactcgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatacttgtc

SEQ ID NO: 6 - DNA, 11189 bp, Homo sapiens
agtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacaggtaaggaaaaaagtctttctttgaattcctggaatttagttgaaaattttggacttcaaaatttgtaaggtgttattgtctagttagttcagttttctgatacaatctggccaggaaatgcatattttaaagtcctctcaccattttccaacattgtataattatagtcacatatccacttacttttgtggctcgtgatctcagccaaggctaaattcatttgaacctacagaatgttttctcatattttttaggagaaaatatttttctttgaattgaaatggactctttctgcattgtagctactcattgaggtttagttgctcttgttgtttttgatgttactgtgtgtatgtagaggaagagagaattttaagaaatacatttgtttagttatgtaattaatgcctagaaaaatttaatagtttggtggtaaccttcaggcttcttataatttggataacctaaatattattgtttcatgcaactttgtgaataattcatgttatgttagggttttaatgtttctatgaaactgttcattcatggactaggtagaatcctttatgtgcctcacttggaaggggaaaaaaagaacaaaaaaagaaagaaaatcctactgcgggttggcaactctaaaaggattttaatggatttatgaaacccccagatttccttacagccacgagctgtgaatccacacatgccagcaacattgaatacacttttttttctgcctgggcacacttattctagtaaagagagtgtgatgacagaacaccttagacttcaacacgcatctgtgcttaaagaggataaaaaacaaagaacaaaatcaaacaagacaatgtatgagttgaaactactaaggttgattttctccaggtttctcaggatctgggcagcgttttgcttcctcttaatttggaacccttgctgtgtactctgactttttactgcaaaacaaattgagagaggccagaggttagaggcccaaactgcatttggactgtcagtaaatactactttgcttcccctggaaatcctccaaaagtctctcccaaacacagggacattttgctgacacagaaatgttccttttaaaatccacactgttctcacccactcttgaacaggttataataaatatataatttaaaaacctcacaaaagggaagcaagtgtcctccttctaccaccctcctcccattaaaacatggtcatgagaatggagttcattgtctcatgattgtaaggactaagagagagagattttttacactaagtcatagagtagagaggataaaatggccaacatataagtatttgtcctcacctaaaggaggtacaagtttgacaaataagcaaaaggaaaggattagagggcagatgactaaaatgttgagtctgagaaagggcttcatccctgtctcacctccttgaaaggcttgcaaggcagcgaacaaacaataaggtaggtattatttttaccttacagttgggttaaaaaaaagcccagagaggtttggtaatgtgctcaacgtcacacagccttgactgcataattccagacaagataatctgattccaatgcctatgcccttgatttgcactgatgtctcttcagactattcaactccaaaggcgaccttatacttgtggccatttagggattgggcccagcttagaaagtcggtggagctgacaaagcaatttccaaagtgggcagatagagcaagcaagaggaaagcccaatcatgagaagccatttgaataaaacaaataaaaaagaattctagaaaatttaatggctgtgttatagcaaatatagtgtcaactaaggggtctatgagctttgttctaaaatatgaaagggagaagggtaaaaaagccaaggagttttatcaaactgagtattgagtatctactatatgtcagctctacactacaaaatatagtgccccacatgtaaagcaagctggactgaaatctaacaatgaggaaaagacaaaaacagacacaaaactaaaggcaaaacatgaaccaagcagcaccctattggggttgaaagaaggagaaatcatgtttacttgattggggagaggcaggtgtgtcaagcaaaaagggagtaaagaagcaaaatgtgtcaggcagaggatagggcgggtcccttgctgccagggacaggaatttaacatcaaggatttgcctggcacccagggcaagtcttctgttcctttgaatggggaaaaaatacttgcttactttgatgccacagccccaatcctaaagatagacacacgtgtcttttaacacattgtctcatctgacaacatgtaataatcttctgcatctaaaagctctgttggaaattaaaatcagaaagatacagaaaggaactgtgcctttagacctctaattgttcaggggactgaggaagacttgccccttggaggaagagtgttagtttccctaatgtcaaaacggcaagggtagaacttcccatcatactgttaagcaggccaaaacttgaaattactgggttggtctttgtttgtagttttcagctcccagatgatgactttttctgttgcctgctttctccccaagagctctagcttacttatgtgagtacatgcacgtaggtctctttcatgtcacactctttcgatgcttttgcccaatcgttcccttggtttgcagagtttctccatcactctgtcttgttttcctaactacctactcatgtcgcaagactcagcttaaacagcatttatttcttgcagcctttactgacacaccctgtccccaacagtgttaagggcatcctgtttttgttactaggacattttatatcatcactgaagcagctatgtattgaaactggagttaaatgcccatatctcctatcagcttatgagggactcaaagtcaaaagccttttcattattggatctcatctaccagactgcttttgcacaaactacttgttcactgtgttgataacatggtttgacgggaagaggggatgtaggttttggaatccaaagacctgaatatgaacataggctctgccacttattagctgtgtgccagtctgaaaaccatataacctttgtgattctagttctttctatttggcataaaagtcattcagtctaccttgctgtgaagattaaaagagatgatgtaaattcctggctctgtaggagctcaaaaaatgatagttacagttcaactgattaaataatgaaaagggttcctgctgtgagcatctgatggtcatgataatgtctgaagtactttattttttaattgttcagccacgaggaggggtggaagaaggccctacagtattgagaaaggctggtctgcttgagaaacttaaagaacaaggtaatttttaagttgaaaaatgatcagcctgatttcctccccactctgaaggaaagagcaggcccctgtgaacctggagtgtgtctggaatatttacatcagaattgcggtactggttacaacccgagaaacacatcctacaaaagcagcagggcatggggagaatgctcaggaaacattgctggatgtacatcctcactcagatattttgtctttccagccaaactacagtataagataaattgtgtgtgcaagaacgggggttggggtggatggtaggggagccgggggaacagcaaatggaaggcaaggtgcagcaggaagtatgctactagcaagaggacccctatttgtgaaataaaataaaataaaacagtaataatgataataacaacagcgcctagtgtgggcgcagtgtgtatatatacatacatatacataagcatgcaaatgcaaatttacgtatatttttaaagtatgggctcaattttctgttacctttacatataagattctgataaagtgttggtcaggatgtggagaaactggaaccctcatatatttctgatgggaatgcaaatgatacagccactttgaaagtaggtgggcagtttctcaggtaaacatatatttacattttgacccagcagttctactcctgggtgcagagaagtacaactacaaacattcaagtacaagtctttgtgtggatatgttttcatttctcttgggtaagagatttgtgcttgaatgtttgggggcagccatatttataataaccaaaaaatggaaacagcaaaatgcccatcaactggtagatggttaaacaaaaagtgtcacatccatgcaacgagatagtattcaacaataaaaaggaatggactggtcgggcacggtggctgaggcctgtaatcctatcactttgggaagccaaggtgggtggactgtctgagctcaggagttcaagaccagcctgggcaacacagtgaaaccccttctctagtaaaaatacaaaaaaaaatagctgggcgtggtggcatgagcctgtagtcccagctacttgggaggctgaggcaggagaatggcttgaacccggaggcagaggttgcagtgagctgagattgcgccactgcaccccaacctgggcgacagagcgagactccatctccaaaaaaaaaaaaaaaagaaaaaggaatggaccgcaaacacaggcaaaaacatggtagatctcaaaagcagcatgataagacaagaaagactacatgtatgattccactgatacgacattctggaaagacaaaagcatagcaaaagaaagcagatcagcagttcctggggttgggggcaagaattacctctaaaggggcaggatggaatttttcaaactcattgacccgcacagttaaaattagtgagttttagtgaacaagaattacacttcgtaaatctttaaaaaaaaaaaaaaaagacaaatacagacacccagtagagaacagaatgcttgggtaatggacttgtcccttaactgacaagcataatttggtcacgtgttgtatcaggtgaaatttcttggaggcgttactaaatcagattcacacagacatgtaacaaataccatatttaatggccaattagttcagaacaccgaactgaatcacagttttacatgacactctctacttttcaagcctaattcaaggccttttagggagcacacccagtccttaggaatttggggttacctgcaatttttccttactaaaaagaataactaaaaagctttatttccgaagcttccaaagtgttaggctcagtgctaagtacatattcacatattcttatttatttatgataataccactatgaggcaggttcaatggatactttgtgtgtctgtgtgtgtgtgtatctccagatgaaaatacaccagtgctttctaaattttctgagaatacatatatataccgatatatatgtatttaattattatcaaaatgaagcatgcttactatagaaaggtaaaaagcacataagcagagagagacagagagacagagacagagacagtggcattccctattaagcccaaaccagaagattatcactgttacattttggtgtctagtttaactggatggattcaagaagtgttcactgagagcccagtatacagccgcaccagtgtgtgatactggtaacatgacgtcaagcaaaagcagacatgggtctaccttcccaagatttacagacctttcaggtttttcctttgcttatacttgtgaatatatgcctattttatacaattgagatcatcctacacagactgatttataatctactttttaatttagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttccttgtacatgatgactttgtttaacgtgtgtgtgtgtgtgtatgtgtgtgtgtgagagagagagagagagagacagatgtctatgttgtgttctcactctacagtgcaaatttccttgttgcttcatgggatgtgcataagcatcataagcatcagttttttaattgctgcatgatttttcatcaaggggttacatcgctatatacgtacatattgcggcatattcaggttgcattataattttcaccattacaaataatgtggcaaagaccatttttgtgcatgagcctctttaaatatttactcccaaggcctaggataattttaccagaaaggcctgattagatctaaaagtagaaacacttctatggctcttgagcagtcaatgacttcaggtctccttggcttcctcttctaaagccaaactgtcaccaaggcctctgtatcaaaactgcaattgggaaactgaggctcgctttctttgttaagtggaaattttaggaatggcacatggcaaaagacaagaaacctaaagggaaaacaaacgtccactgaataatccatacctgaacgttaaggcattattgcttccacttcgagaatctaaaagctcatgattctctgaatgatacttaaacattcacaaatgggagaatacaggcattgtatagtactagcttggtgcaaaagtaattgcagtttttaaatggcaaaaccgcaatacttttgcaccaacctaataaatcctaacttttaacttctgtgcaagatatcatttatgtcttccattccagcaaaatgtctggagcttgaagtatttgggatgaactttgttcctggttgagtgggtaactagatgcattgaatagaatgagtgaacacacgccatacgctggctgaagaacttgagtaagaacatgtaagaacttctgagtgatgctctcaaattataaaagctggattttaagaaaaattgaaagactttgtcataattcacttgagagaattaagtatttaccaagagagatgagtgtacagaaaatgatccaaatttaactctgagaattgaacagtgtctcatgctaaggaatttcttgtgtggctagtatttttatactcatttatttttttggctacgctctaatcgtggttttcttacaaggtggattttgggaaaaaaaatcacagtttttttagtaatgcaatcgatgtaaatataactagttagtgagcattaagtgtaagttatgctttctctattgttttaactaattggcatctccaattcagaacctatcagaaatatcagacactgtgactcaaaggaaaaccaagtgggagcattgagtgaataatatgatgtatgtagtgacactgcaaacctgatgttcacacaaaattttttccccaaaagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaaggtaaaagactggttggtactctagtgcaatagaatactttttagtagacattcaggaggtggaagggaaatgagaaactccatgttatcttattcttggtgtaatctcaaatcattttctctgcagccaataagcaaagggttggttgataaaaggcagtgaggctctctatctctgccttgcaaactgacttaatatatattttctctgctaattcttaaactatccttttagtaggtggggcagagagtaatcatttataaacaggtcagtggaggttcagaggttaaccaacttgcccaagatatatgccaagcctatagtgaagcaagggctagcaccaggtctcctcattccttcctctttccactacatgccacacagttctgcattcttactgagtagtccttctatatcatagaggcttttcaaaaaagaaattttaaaatttcagatataatggtttatgaactaatgtatttactgggagaagcacctatctaaatcataagagaaagaactatctccctgctccctagaaactccttttctaaaagatggaaaataaaatggcagattaagatttaatattacagcttataactttgttgatatgccatagtttgttgatatgccatagtatatcaataaaaagtttttattgatacaattataatatttggtccttatgatgatacaagaggttaaaacctccttatgttaaatgctcagaaataatgtcttttgaactaatgaccaagggatgggtttataaacttgcaaagtatctgcctagtacatgggaaaaactaaacgtcctggaggacaaagcagatatcatcatattatcacattaagaataaccaaaggacaggccacaaatttccctcagctgctctaggccatcctctggattaaggacttactgagaaagggaagtaaagaaggaagctaccaaagtaatgggagcacaatcgtttctttatagaggagccctgggaaagaagggcccagcaggactggggcacaaagtaggtaaatgccaactggttcaaggcaaagtcaaagcaatcaaggggaggcacacatcctcttcttaattgtgtattatttttacatgatttcttctgtatttatattctaaatataagatatacgcaatccaatatgtgtctttacctttgaatgtaggatttgttcaagagaatcatacataaccaagtgaaaacattgtaattttagattcccgatgtgccaggattctcctgggtgactccctgtatatctgccaaggatattgtgtatattggcttgagagacgtggaccctggggaacagtaagcttattccttgatgtgatttgcctccatttttgtccctttgtgtgctagatatgctttactgaccaactctatgagagaaaattaaacatcaagacacacacacacacacatgcccacacacatatatttatatacatgtacatacatatgtatgtatccaggcaattaaatctcaattgacttgctgttaaaaataaatacaaataaaactatattgagttaggttcatagaacctaaatgttttatatattttactatatttatatttcccttaaaaggagacaggcgggcacagtcagccttattaattataattatcttaatttctcttttatagctacattttgaaaactctaggcattaaatacttttcaatgactgaagtggacagactaggaattggcaaggtgatggaagaaacactcagctatctactaggaaggtaggattcttttgtgtgtgcacacatgtgtgtgcaacagaaaaggttgctactgacaaccaaagttattaataaagtctttacatgaaataatgggttgctactttttataaaacaagttaacagattattatctatgaaatgtgaagccatcaaccttaaactgaaatcctttcccacttcttaaaagaaagaaaaggccaattcatctaagttttgatgttgacggactggacccatctttcacaccagctactggcacaccagtcgtgggaggtctgacatacagagaaggtctctacatcacagaagaaatctacaaaacaggtagttaacaatctgaggtaatagagaagcaagtgtacacttgactaatatatatttatacctccttgacctgaaaccaagtcccagctgacactttcagaatgtccatcagtcacatgatgcaataactaaagtgttttccatcggttactacctttttctgttagtggataatctttcaagtctgtctgtactactttcaaaatgtcaactattttataaattacattattacaatttgttgttgtagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagatta

SEQ ID NO: 7 - DNA, 20700 bp, Homo sapiens
gggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcggtgagcgcagcccggtctggcgcctgcagctgcggggagcgcgccaggcagagggagcggggagcggggcgcggggcgggcctcggtgtgcgggcggcgtgaccttcccgagcggcgggggaagcggccagcgtcgcagcgcacgtgccgcgggactcggagaatctcggggttgtcggcctccttcctgcagtgcccacctggtgggaacttttgtccttgtttgcccccaagtcctgtcatttggctgcggggctccgcgcctcaggggcgccagtgctgggcagcatggagccgcttgtgaatggagacttgctggctgcccaggagtgggcggctgggcaggggcggtgaacgtttagggtccggccaagaaagttggaagtcgtctccctgacctgttccttgcgaggcccgggaggagacgcgcctggccggtccttggcggcgaaactgatttgcatctccacgctttacctaaagcccgggctctggggactggatggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaatttgagagaggggtcaaaggcgctgaaaagattcttttttctattccaagtgctacagcaagctcataaatcaattttaattcatgctgaacagtcttgcctcctccaagccctgtgtcttctccaagccagagctacacataatgtgaattagctgcccactccttctgagtgaatctgttagtacccatcatcgttttctatcctaataattctaatggctatttgtagaatttatttgtttgtttatttttttgagacggagtttcgctcttgttgcccaggctggagtgcaatggggcgatctcggctcaccgcaacctccgcctcctgggttcaagctattctcctccctcagcctcccgagtagctgggattacaagcatggcccaccacgccaggctaattttgtatttttaatagagacgggggtttctcatgttggtcaggctggtctcgaactcccgacctcaggtgatccgcccgccttggcctcccaaagtgctgggattacaggcgtgagccactgtgcctggcctatttgtagaatttaatgtgtttaagtttggctcacctaacagggtttaattcttagggacagatagaatgtaatgtgatgtgactttccttcaaaattaagaaggaagtgtctgtgccaaaagaaataagcgcattgaggtttatctaggaggccacattgtacttgcctctgtctgtctgctcagttgcccccgtttttttctttcccaaaaatatagggttgggtgttttgtgttgcctttggccaggttgaaatactcagattaacggttggtttgtaggcacaggcctgaaaagacaggactttgaactgaatcctctgtcactgacagttgtgtggccttggagaagaccttgtcttgctccaggctttagtttgccttctgggaaaggattaggaccctgataaactttttatttatttatttatttatttatttatttattttattttttattttctattattattattatttttttttttgagacagagtctcactttgttgcccaggctggagtccagtggcacaatctcggctcactgcaacctccacctcccgggttcaagtgaatcttctgcctcagcctcctgagtagctgggactacaggtgtgcatcaccacgctggggtcatttttgtattttaagtagagacagggttacaccatattcgtcaagctggtctcaaactcctgacctcgtgatcctcccacctcagccggcccaaagtgctgggattacaggcgtgagccaccgcgcctggccaggaccctgataaacttttttaggaagataccagatggccaccaccttttcagcctagtgaatggtcctgtctctccagacctatcaacagcatataaatcagtgtcttgcacttctaacttagttgctttattaagtaatgtgccgttgttgccactggttttaaattttttgtgaataaaggaggattattgaagtctcgtcgttggcaagatgcttcaagaggtttaaacaacttctccacggccaatgtttcctgttgacgttcagggtgacattggtgttaggagcgtgcttggtgttcatctctgatccagcacgatgggtcacacggctcctcagtgtgatgaggaataagttgttccttattatttgcaaataagttactaacaccgtttgaaaactgtacaggattggtcgttgagttggatattttagtcaacatttattaagcccatgcctcaacagtagttgacttttgtctaaagagagagaaagaaattctagttttcccaaatgcccaaggctccaaccaaaacatactgaatccagatttccagaggaaagtcctggcaatttggatatttaataagtgctccaggttatcaagtggatttggacacaacggcccaggtgttgtatctcaaagtgtgagtctgtggactggcactgtccgcctcacttgggaactcatcagaacaggcagaacctctggtcctgtccaaggctactgaatcagaggccgcattttatttagcaaggcccccaggctactcctgcacacgtttacatttgaagggctggtggtctgtggtgacgggaagatgtgtgtgacaggaagatgcttgcgcagggccttgttctaagaacacatgatgcttgtgcacggtgtggcgtcccatcagtctgatgtggctatttgtgactgtgtttgttttataatatttttattattcaccttgtacagatgaggactcccagctgtagaggctgaaggagccacactgcaggtagagcaggcattcaccaaggcgtgtgtgatcccagggtgcagctcccacccttggctgcctgggtgctcttttccagacctactgtcttgtgagatccccttaggcacccagcacaggctgctgtctgaatttagaactgagcctgttcaattgatggctcaacataggcctctaaaaaaacaagtctgatgcggtttggtacacctgtggttggcttacttatttggtgttcgttttttcagttttcagaaaggtcagttgaagtgctgctggtggctgtagcattgatacacaggggaggtttttgatctgtgagctttctaggaggcagttgctaagctgcactgataccttgagcccctttcctttggaacagtgtggaccccaggtcatggctcccagaagtttaggttctgtaatttggctgcaggcctagagaacaggatgctgcagacttggactaatggtgaactcttgcctccccccagggatatgtggtgcctgtcataagctccagagagctgccttccacaagaccagcagaagagtgggcaaacatgaaatccaatcctgctatccaggctgccattgacctcacagcgggggctgcaggtacagtcatgtgcctcatcaccatgtttctgtcgttgatggatggtgtatctgatggtggtcccatgagattatactaccatatttttactgtaccttttctgtgtttagatacatttagatacataaataccactgtgttatagttgcctgcaacatccagtacagtaacatcctgtacaggtgtatagcctaggagcaataggccataccgaatagcctaggtgtggagtaggctacgccatctagggtcaggtgtgtatgctctatgatagcacaatgacgaaattgtgtaatgacatgtatttcagaacatgtcccagtcattaagcaatgcctaactataatcccagagaaaacccagttctctctattcctcaactactctctaaatgagatcaaatgaaagtggtatgaaaatactacctttctccctccagtactttacctttgggattaatccatttgatggaagtttagtattgttcagagagtagcagaagctagaggagtgtccgttattgttaacaccttgtcagtcagggtgatgggtggaaggtgcccagtacagctggaaaacagctcagaggtgaagccacgtgtccattgtcacctggctgggatatgcaggtgatgtggttcttcacttcaagcctggcagtcttcagagcccttgttgtgcaaaaataacaccatagcatctcctgggaaacaccacttactgtccctgctagtgttgggaaagaaaggaggacactcttagaaatgtctttaaaaggctgggcgcagtggctcacgcctgtaatcccagcactttaggaggccaaggcgggcagatcacctgaggtgaggagttcaagaccagcttgaccaacatggagaaaccccgtctcttctaaaaatacaaaattatccaggcgtggtggtgcatgcctgtaatcttagctacttgggaggctgaggcaggagaatcgcttgaaccccggaggcggaggttgtggtgagccaagatcgcgccattgcactccagcctgggcaacaacagtgaaactctgtctcaaaaaaaaaaaaaaaagacatgtctctgaaaatgagactgataatggactgtgtcttagagccgtgaaagttgtaggatttgctgggaatgtcagctaacctgagcctaggggcctgagcccaagagcctgaggctcccccagcacagggaggtgctacctgtgataaggggtagtgctggcaccatgcaggctactccttagaaagatcagcttgaacatgcaggaagagcaggaccctcaggctgggaaacagggcggaatgggaagtgcatggtggtaatttggttctccagagtccagaagtaggaggagtggctggaatactgattgcccaaaggaaaaccctggactaccctgggctcccgcaggattctcatagtagttgcagctccctggagtggggaggccagcgggggtgttgcccagtgctgtccttatccagcacaccccccacccccaccaccagcagatgagtatggtcatgaatatggtcacctcatcagtcatttgctcaattgtgaaaaagaaattgttcagagaagagcaaagtgtttttccatgagccaaaggtcagccagggtatgctaatgaggaagactggagagagcgcgtcaccgtcaccgagcctaatgaggagcactgggcaagggcacttctcccagggcagaacccacaaggagcgtcccagccccagatgcccagggaacggaaggccagtgggggtctgcccagtagtctcttgcccactgcgtgcctttaggctacagcctcccaagcccctttccccctcccctcccccatgccacactggggaggacgctgaccctgagaatggtgcaaacatctgcctgccccaggccgcctctcaccagcgagtgaatgctcttgggctcagttctgtttctgcagaaggagggtgtttagccacatatagtctcagcttttgacattttatgtctttcagtcaatctgtcaaagatctagaacctatggtgatagaatttaaaagtttaccttttcctatttatgtgcatacaggtatttgggtaccacatttataatttacaagttagtttgaaagatagaaattgcaacagtatggttgggagcctggtatgtaaggcatttgctggtgggcatgttttgaacatgtattgatcccttatgtatactgacacactgtccccatcactgttggacaggtatttccccctgtgctggcgacacagggacgcccctcaccgaggtagagatgctgtgggtagtcttaacttctgaggacaacgaagcccattcctggggggacaggatagggagggggagcgagacatggtctataggttgggggctgggcagaggaggtgcctagcagtgacacagaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcatctgcagcacactggaggggagggttagtttggagcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgggaagttcccatttccctatctgcaatggctgtaagacatctagatccctaaacagctaggataaaggaggatttcaagaacttaggtgattaggtaattattgaaatgggggtgcgtggatcccaaaagttaaatagccttaaagagaaacttggtaccactttaatagtcattcagcaactctaaaacaatgcagtcactactttgactactgttgcagtttaccttgtttagcatagttggagaatgtggcatttcagatcattgaagtttatcttctcaaatgccaaaattaaaaacaaccccaaaccttttttgattggagtttcttgaaaatgatattcttccctgccctgttaaacctttacgatggcctccagaggggtttgagggtctcacctctgcttggtgggcctggtcctgtggtgtgagtctgcttctctctcctcacctctctgccttcttcagagctgtcccttccctgagacactgtccctgccctgatagatttcctctgtatctcgtgatttactgactctatgtcaaggactgaaaatccaaaccaccacccttagtaaagtgttaggtatgacataatctgagtgcctttcctgcggaataagatgcttggctggccaccatatcgccgaaagaatgttgttatttgtcttttaaggagaataagatcagaagtctgatttctaggcaagtggagaaatataatatttattcatggctttatggacttgatcgatctttgagaacctactaggtgtcagtctctgtggttggtactggtgttcagaacagtcttctctcacttgagggcacagtgagcgccgtgaccatatcatttgtggtaaattacacgggaagttagcttacccttgcagaggacgggagacagttgttgctagcatttgtacattcattagcctcccccttctccctgttggaaatgtaactgtcccagctacacagcaaatgtgtattctagtaacctgtgatgcctgaactgttcaagatgatcaagttaaaatatgaatgtgctgaattaaatgctttattcagcttatctgcatctaggctctctgaattacgcacccacttaaaacattctgtcaccttttctcttggaataattaaattattttaatgtaattcagatttctttttatcctagcccagcattacctgggagagaatgactcaggattaatcataataaaatcatattaaattatattccactaattcagaattggggataatttggcaattaaaggcggaagtgtgtcattcctctcctgtaagaaatgaacagtaatgatgggctcacagagatcatattgcttgttgcttaaaaaagagatcaagcagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggttacagttcattcttctcttctgtttagaatttttactaaaatgatttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagctgagattgcaccactgcactccagcctgggtgacagagcaagacaccatctcaaaaaaaaaaaaaaaattattttgtgcaatgtagactctgctgtatttaatcttatagaagtatataaataaaggatttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgccgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggtaagttctggggtaggctgcctgtgccttccttccatggataatggaactgtagcctcgtactagagcagtcatctgtcctgattgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggtgagtcaaggacacacactttttttatttgtttaaaaaaaccccacaaaactggcaagacatggtggctcatgcctgtaatcccagcactttgggaggcaaaggcaggaaaatggcttgaggctgagagttcaaaaccagcctgggcaacacagcaagatcctcatctctacaaaaaaataaaaattaaaaaaaatctactgttgtatggtcacaattttactggtgccttatgtggaagaacatttccttttttaaaaataactgctttccttttatttatgaagttatacattgtcatcatataaaacttagaaaccacatatgcacaccacagaggagacctgctcatcatccaccactgagaatgaaccgcccttctgtttcagttttctccaggagaatgctgttcagatgcagctggcagtgctacctctcgtcagcagacatgctgcactgaaactgtagatgctgcttatgatccaagatttagcttttctttcattagcaaaaagcagagtattggaagaggttgtctgagccagatgaacttgaggagttttaggaagggtcggaaatgtctgcgaagatgcaagggaacccacctttctctgtccaaatcttcccaaaacatcagactttgcctctttgttggtcttgccttgggtatttattatatagagactaaacagaatttggaaaccactgggatgtttagctatccctgctttgaatgttgatttattttataccacttaaaattattatataagcttcaagattgcaaagggcagtcttagttatttcagtaggagtttgaaacctgattgcagctgcaggtcccacacaactgaattcggtttcttgtgcacagcactgttctctggaggtgcctggaggtctgaaggtgtgcccttttatagacaggaattccaccatgatgggtagagcttgttttttaaaaaggcttgggactagatacgattgcccaagaagacagtgtagacagcgaggagggctgagcatgaatgggatgagcctccagcacagaaagggcaggcaggaaggcagtaaagaaacaagcagggcacaaaccaggagagtatggcatgccatgatggagactgaacagaagcaaaaactacaggcaactgtagttttgttccctgttgaaggagagacactctattagagaagacctggaattcagttcagtttccttagcaaaggacaaaatggggagagaagacagggaaacagtaagcagccacgtgagattctggggaagacctgtgtcttctgagcaaagtagcccctccagccacaggatagacagtgacttctgtcttgcatgagtgaaaccactggatctggctctgcccgcccctccactttcttgcttccttagcctgtgaacaaagtgaaggacaggtaagagcatattgcttttctgctgagaacaatctaataccttacagctgcattttcccacactgctttcagaacattgaattgctgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggctgaggtgggcagattacttgagcccaggagtttgagaccaacctgagcaacatggcaaaaccccgtcactacaaaaaatacaaaacttagctgagtgtggtagcacatgtctgtggtcccagctaccagggaggctgaggtgggaggattgcttgagctcaggaggcagaggttgcagtgagatgatgccactgcactccagcctgggcaacagagcgagactgtgtctctcaaaaaaaaaaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccgtgatcctgtgagaagagcaaggcagatgttacctctcttagggatggaaaactgaggtgccgatgttgacctgctcaaggtcaccccgctaaggacttgaaattgtgtcctctgagctcctgcccagtctcctttccatcagaccacagttgggggtctggaatattttataagggtcagttctagagagaagattaatcaggagcagtgaaaggaaagaactgcttgtgagagcctgtggtgaatttctgcaatcacattgtaaatatttgtctgttcccggtttcaacatgacccagaatgttctagtttgacgtttggctggacagggtcttacatagcaggagtgctcaggtacatgtttgttgaacatatgacaaatggatgattcttacaaaatcccatcctatacctattactgtttcaattccagttctacacattcatactacatgcagaaccaggggcccatgcacctccttctgtgcactggtcaatgaaagtatttattggaaagccaaagtccactgcatatctgatttgactgtgtccttgcactataataatgtgcttggtgttcattcagatgtctgagccattattatatcttaaactcaatagacttctacatttattgactgccacctttgtcctggcaaacttggcagatcctggttaatgctcctaattgactattgcctgtcaacaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgtgcaagtacatttgtgtacctggttctcctttgctaatggttttaggcttaattctctaacatcaaaaggaagtccttactgcaaacagtgtcttcctactgaaagaaagctccactctaagccaagtcttctgaaagagttgcctctggccatggtacagaagctagaccaccagggactagcaaaccagggccaagactggtgccaccttgattttatactaatctttaacactggaaaaacttgagtacccctgaatatggtaagtccatctgtgctttttttttttttttgagacggagtctcactctgtcgcccaggctggagtgcagtggcgcaatcttaactcattgcaacctcgcctccccagttcaagcaattctcctgcctcagcctcccgagtagctgggactacaggcgcccaccaccatgcccagctaatttttgtattttagtagagatggggtttcaccatgttggccaggatggtcttgatctcttgacctcgtgatctgcccacctcggcctcccaaagtgctgggattacaggtgtgagccaccgtgccctgccccatctgtgcttttgctcacagtttggagaaaaattgttaggggattatatctctacctgagtagttagctgaggagattcccacccacccttaggggtttttggaaatctctgagggtgatcttggctgtccagtgagagcatgatgctggcattgaatgggtgtcagggaaccagttcagtccttcctgcccaatgaaggattgtcctacccccaaatgccagtcatgatcccatgacacaacactcttctagggctggaagggatcttctatcccaactcccatgaaccaggaactcgcagagaagcctttcttctgaaacacttctcagacttttccccgtattcgtttttttttttttgaaagagtctcactgtgtcacccaggctggagtgcagtggcatgatcttggctcactgcaacctctgcctccctggttcaagcgcttcttgtgcctcagccaccagagtagctgggattacaggcgtgcaccaccaggcatggctaatttttagtagagacggggttttgccatgttggccaggcctcaactgatctgcctgccttggcctcccaaagtgctggaattacaggtatgagccaccacgcctggcctccccatattcttgaactcttactggattccagtttcacaaccctgctggtgacatttggctgctggtactaaatccatacatgaggtgaatgcttctgttttgtatttgtgcattcatccctctgcctagtttagatttccagtttagcaatttcacctaataccattgagcttgcagacttgtactggcttcacccactcctgtggcaccattttaccctcgtctgtgttgctgaggtggtaggtcaccagttgaactggaaaatctttttgtgatgcagcaacttttggttaaacgttttttctgggttttcatctgtggcagttacattgcacatctggttgctccaggttggattgtgggcatgtggggataggcttagaacctagatttatttaaaacttagggcagacacactgaagtattaatagtgcatgtttttcagtgggggactatgggcaatattttcctcctttcctttaggtttttttgtggcgttttattttgtcatgtcacgatgtatcttggctttggctgttgtaacagaatactacagattgagtggcttaaacaaacatttctcacagttctatggtctgaaaagtctaatatcaaggttccagcagatctggtgtctgatgagggcttgttcttaatttgaacatagccgtcttctcactgtgtcctcatatggcagagagtgagcgagctctctggcctcttcttctaagggactaatcccatcacaatggccctatcctcatgacctcatctacacctgattactcccaaaggccccatctcctaacaccatcaccttggggggataaaattcagtccatagcgctgtgtgtaatcaaaagaatatggttgttgcagtcaggaagacctgggttcacatcctagcactgccacttagtagctgtgtgactggccacattatgtcatctctaagtgtcacttcccatagggaactggggtgctgctgtctgcttcatagggttgtgggatccttagatgaaacagcacatgcaagtttccttcctttcatcattttttttttttttttgagacggagtctcactctgttgcccaggctagagtacagtggcacaatctcaggtcactgcaagctctgcctcctgggttcacgccattctcctgcctcagcctcctgagtagctgggactacaggcacccaccactacgcccggctaatttttttttttttttgtatttttagtagagacagggtttcaccatgttagccaggatggtctcgatctcctgacttcgtgatccgcccgcctcggcctcccagagtgctgggattacagttgtgagccacggcgcccggccctttcatcatttttttagacatggaggtctctctttgtttcccaagctggaatgcagtggctgttcacagatgcagtcatagcactgtagcctagaacacatgggctcaagtgatcctcccacctcagtctcctaagtagctgtaatcacaggttcatgccctcacgcccggctccttaccctgctttatcaccaaagtgctgtctgtgtggtgagtgccaaaggaatgaagaaactgaggggtaactgtctgcttgtgtgctttcagtgatctgcagaatgcagccgccggttccttcgcctctgcctttgctgcactggtgctctgccccacggagctcgtgaagtgccggctgcagaccatgtatgagatggagacatcagggaagatagccaagagccagaagtaagcaccacttgggcacaaacgtcaggtctctattgccctagtgtattggatgatttttcattttacattgtactaaagtggcagatgtggaagccaatttatctactccaaaatattgtttctagaatgctttcccctatcagagattttctgaaaggattggctgtgatgggacccaccacccactgcataaaaagtcttagacagatatttaataccccagaactggagaagccaggagcttaacaccctttttggcctcttggaaacataaggcatgatcttcagccatttttggaggtacataatgggtggcttttgaactttgccttagacctgagccttcataagtgccaatttggattctgagatgaatatttgatccccacttcaggtttcgtatgggtattcaggctgattgacccagatcctagaggtaactattcttaccccacttatccccagtccttcaagtgtacctgcagatggcccaagttctgagaacattaatcaatacttttataagcatagctactcttcagtgattaaatcactctctagctcactcttgaaaacacattctcattatcctttgagagtactgtttcatacacaatttgatttacttgaattggaaagcaatttattatccttattaattgcaaaacttgcttacttatcttgacatctggctgagttctgaccaaggatattgctgtggttaactcaaagcctataaatctgctgggaaaaagcagtagataaattgaccattttcaaggatcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagctctataaatagtgacacaatttatgtgcctttgtaacctgtgtccagattaacaaatagaacattaacaacacccagaaagctgccctcatgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgtagcagtgctgcaggaagggctggctgatggggaatacctgacagtgtcttctgaagctctcagaaggaaaatagtttttaaatgtctgtggcctttattaccttgggacttgatccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttcagacaacatttactccttcactcatttctctgcactaaaaacagatcctgtaaacacctgaacaaatttcccaaaaacacaccagaaagattgaggaaataggaatcacagcgataagggactgggcaatacaatgccattttatgtttgctgagtttagataattccttactgtaaataaatttccttcccacagaaggatgccgttgagtcttaattcctggctcttcatttacaaaatcagcttcttccttactagtgcttgatcagatctgttaattggttgcaaatgcccttgtcttttcttccttcccacctgctgtaaccgtgctatctctctgtgtctcctcccagtacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggtaaatgtgtttgcattgacagcagtggggtgtgatggtgtttgctccctgcaggtatggtttctgtggattctctgccctttgtgctctcctccccacattggtggctccatctggcacagggaagcttctggatgcctgaaggtaacatggtggcaggcagttgatagcacccaccctccaggcctgataatttccttaggacagggcctgaagcagtacatcccaaactttcttactggaataaagttttttaatttttctggatctattttaggggagaagaaatccagaaattactttcccaattggggaatcacctataaataatcttgaaataaggttaaaacttggaaatcttaatagtgttttgagagcagtgaaaaccatagttctttgtagcttatcgtgtttagctggttggtacaactacatgcaatgtttggctcacataagtgagtttttcttaccatctccctcagtgtgtgttgaatctattctgtggttagtcaagctcccagacttaattgctatgtttaataaaaacaattttggcttttaatgataaatgaagaatcagggctattaaaatacttaagagtgagaaagttgaaaaaagacatagattgtgtttggcctgtcttctccccactgtagggggttgccactcagctggaggcctgctggttcgtgtgggccagcccttgacacctcagtgaccaagcgaaatataaccctcactaaggcttcttgtacttggcaagacccaggagtagacctgggctaccaaacaaaaccctgtgttcttagagcttgggaacaagagctttgacagttttcctcaaagaattgtattctgtagcattagcatttttattttcatctacctgcagccattactacattgacctctggaaatgtcacatcagctgttcttgagacaaaataccatttgctattttttttttctctaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggtgagtaaatacctgtttttcaagcatctatatacatcttaaaatctgagatacgggccgggcgtggtggctcatgcctgtgatcccagcactttgggaggctgaggcaggtggatcatgaggtcaggagatcgagaccatcctggctaacacggtgaaaccccgtctctactaaaaataccaaaaaaatcagccaggcgtggtggcaggcacctgtagtcccagctactcgggaggctgagacaggagaatggcgtcaacctgggaggcggagcttgcagtgagctgagattgcaccactgcactccagcctgggcaacagcgagactctgtctcaaaaaaaaaaaaaaaaaaaaaatctgagatatgaactctgttttgattgtaaaaagaaagaggacagtaacacagaaactttgtgtcccaaatagaggacagataccttgtctgttactcatagtaatcctcccttacatttgtataacatgtaaagttttacaaagtacttacacctcccttatctaattcaatcttcataaccaccctgggcagtactaatactatacacaggtctccaacttcaaggttggtgttcctgccactgcccaggtgaagctgcaaagctgctgccacctctatctccatggttgcctctgtctggccatctcaggcctcagctctgccccatccatatactaagagttaaccaagcgtggaattggggtatgttacctgagcatcagtcagttttgccaggagacctgatacttgtccttgtttccattagtctatttaggaaaagctgggaatgcatccttctatgacttgttggtttttagcactgttgtctgggtttgcatgtgtaaatatacctatgctatgcagctgcgtgggtatccccaaaggagggattgttgcagtctttgaccgcccttttatttgctaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaaccca

SEQ ID NO: 8 - DNA, 201928 bp, Homo sapiens
aatgggcgggcagcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtaaccgcgggcccgaggccggggggagcgcgcctgccggatcagcctgggggtgcgagaggctcgggcgctcacgtgtctgggttggtgccacaggcggagcaaaatggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctgacggggctgagccagggccgacgaggaggagcgggcgcgactggggcctggtgcaccctgggccggcaagcgctgggggtcctctctaccttcccagcgcgctcctgctcctgaccccgctggttgttgactccggcttcttccaggggccagagcccgggctgaagcctgatcctattacgtttcaagggctccgccctcccgcgggtggggaagttactttgacttccgttttggaaactgcctaggagacttggtctgcgcctttgtgaataaaaagtccagggactctccccctccccgctttcccatcattcccatcttccccctccctctctccatctgacaacacttagatacccgcctcggagcatttgagaggcttctttttgggaacgatgaaacagattgtcctgggagcctgtcactcctgtgaagttgtacttgaaaggggttctgtgtaatgtgaatcattcactaacccagaggaaaggcaactccaacacttgacctttcctctttcaccatttcttgaaacctggacaccatttcagtctctttggactgcatttcaacttctctggcagaataccatatttagtcccaatcacttgaatcatttggaatttattgcttttaatttaagttcacgaaggcagccctctaatcaagcctatacaacttcttagctcattttaagtgcagtgaacttaaatatacctaacatttcaaacatttgtccttaatcaaaactctgtgataaccctcaagaggaaaacatggccaacacatcatattcctatttattcaagcaaactaatcacatttgcaatggaaattgtaagcagacaaatatatttaaatgctgttctatgacttaagtctctccaggctccccaaatccgtaggcttcttcatgttgttagtttctgtggtctaagtggcatttctcttttctgtaattactctgagtttcatccttaggaaagtactctgggtgtgtgggctcatgtatgtttgcatatgaacacacaggtgtgcgtgtgtatatctatctataacttttcagcagtttctctgagcatcactaggattcaattttggaagctgccttaaccctttcaagcccaatagcccttgaccttttttttgcattaaatttgcatgcaaccaaggtacaaggcttggtatgaactaattccctagagtaggtgggactaggtacccattctttactgttagttttatatctgcaggtaatgtaaatacttttactttattaggagataaggtaattgaggaacataaattgagacgtgtgcatagaaatggagtataagacttgagtaatattaagtaaaataagtgacctggtgctgtggctcatgcctgtaatcccagcactttgggaggctggggcgggcgggtcagttgaggccaggagttcgagaccagcctggccaacgtggcaaaaccctgtctctactaaaaatacaaaaaagttagctaggcgtgctggtgggcacctgtaatcccagctactcaggatgctgaggcagaagaatcgcttaaactcaggaggcggagattgcagtgagccgagattgtgccattgcactccagtctgggcaacagagcaagaccctgtctcaaaaacaaataacaacaacgacaaaacataaaataagtgatatggaagttagttcaactctttggttgtacttctacataatagtagaagtgtcacatatcaagggcagttgatttttagctaagtattgagtcagggaaaatgaaatgttcatttttactacttgggagcttgtgtttttgtttatgtcttcatttgcactcacctctttctgtgatatctgatggctcacatcatatatacttattttgcaatccaataagatatataaaaatcaattccaagtagatgggaaaaacaggacaaagggaaagtaagacaaagccaggactaaggttagtggaacattatgtgcttactagaggtgattgcattttctcccagccaaagcaaagaggaaatgatcagtgaggtcatttacttgggagagaagtctccttatactgctctctgagagcagttttttttttttttttttttttgagatggagtcttgctctgttgccaggctggagtgcagtggcatgatcttgcctcactgtaacctctgccttctgggttcaagtgattctcctgcctcagcctcccaagtatctgggactacaggcacgtgccaccacacccagctaatttttgtatttttagtaggccaacatcatgttggccaggctggtcttggatctcttgacctcgtgatctgcctgccttaacctcccaaaatgcagggattacaggcatgagccaccacgcccagccgagcagtttcttttatatgctgtgagtgaacggcatttgaatctaccttgtgaccacagatatatgtctgtgggttacataaggccatttcttatcatgtccttcattataactcaatggcagtgcagtaaatgtggccttaaaaggtccctcaatgaagctgctggtctaacttattccaagaatgtcccttattgaactgcctttgggcatcacctttatcggttgattctgttggcagcctgagttaaaggctgtgctccttgctttttccctggagcatagctattccatgttgccagctgaacacagagccataggggtagggttggcattccctcttaaaagttgaggagcctggataggagaggacttcacctcaatggactgttaggaaattgggctgagactctggggactcagcaactgtgagaattccaacactcactacactcactgtgacaaattgtttgaatatttaagcagatttggtattttctggatagatgtagccacaactagcaattagttttctgatctgtttctttctttggtctttatacttatttaaatacagctaattattcatgaccttcctttaaatagttttaatggggagatggagaatctagtctttggctgctttttattttgaattttgctatgaagattactagttaatggttcaagaagtgtttgttttctttcgtgaatgaacattaatctaaaactcttagtattctgagattatctcaaaaagtgtccattctcttgctgcctacgtttgtaggaataatccttgtgggttcccttgttagatctgcctgtactgtttgcgttgtttgaatatttcttttaaacatttcccaaaactgccataaaaaaacagttttaaaaggtggtaattgagaggtcacccttttcttcgtctctgcccttttcttggttaaaggagagctttcttcttcgtcattggttaaatttatgcgttacgaatgatgtaattaacctatatgaacctactaaaagttagaatatgctcccttgagttcagacctgtgagatgttctggggtaaaactgaacacagaccaatattagcctagaaccaaaagaaggaaatttgggggcacattaaagcattaataataaagacaatttggtctgtaggactagtacactttgtattgacttttcattcttggatgagttgttgctgtgatcattgattcatttatgtgtattgtgttctttccagtgttgcaaatgggacaaaattgagaatactaaaatgaattgttagctgggcatggtggcacgcatctgtggtcccggctacttgggaggctaaggcaggaggatcacttgagcccagaaggcagaggttgcagtgagctgagatagcaccactgtactccagcttgggttacagaacgagatcctgtctcaaaaaaaaataaaataaagtaaaataaaataataaaataaaataaaatagaataaaataaataaaatgaattggactccattttgatgttcaagaaaaccaaaaccattccagggggctaagttctctgatggaaatgctcccactacaaggtttgtgggagcagtaggagaagagcccatttctgaggagatgagggaagtcttctgaaaattgctagtatttcagaaggaatggatggggaagagtaaagatccaatccagtggttggaaacaaatgaagggctgggaggtgagagcacaggctacatttagttaacagcaggtaataaaaactaaaagcagctgacacttactgagcgcttactagataccaaattcagttccaaatgtgtttcattgttgattcatttaaaattcagttccaactgtgtttcgttgttgattcatttaatgcctcagccttttgagttagttactatcatcctttttttatagatgaaggctctgagataccaagaggtgatgttagtggcctaagatctgataagtatggctgggtacggtggctcacacctataatcccagcaccttgggaggccgaggcaggtgaatcacctcaggtcaggaatttgagaccagcctggccagtctggcccatctctactaaaaataggaaacaattagccgggcatagtggtgcattcttgtaatctcagctgctcgggaggctgaggtaggggaatttgcttcaacctgggaggcggaggttgcagtgagctgacgtcgtgccattgcactccagcctgggtgacagagcaagactctgtctcaaaaaaataaaataaaataaaaaagatcggataattaggaaattatcgagctggggttcaaatcctgccagtctggctccagcagctgtggcctcactctgtccaccatgtgtgcctggtagtttagtgtggtggagaataaagtatatgggagaggtgtgggagatgacttaggagaggggtaggtgtctcagtgtaaaccagacttttatttgagaactgccttacctagtgctttttgcatgccaggtacttttccaagagccttacaaatagtaactcaattaattttcttaattctaagaagtaggtgctttctgtttttgacttcaacttacaggtgagaaaactgagttaggggaggttaagtaatttctcacgcttgtgcaacaggtaagtgctacagtcttgatttgaaccttgccaatgtgtcttcagagtctctgctcttaacctctgcgctgctctcccaggtcttaccaagagttccatttgcgaaggtgtatgtgtgagagttcacatgccatcgggtatggatgtgtatatttcctgatcatcccagtccagtagttcttatcttagaacacctttgtcactctgtatatgcttcatttcagtgtttattaagtgtatttctcatctctccaaccagatcgcaaatccctgcaggacaggaattgtcatataccttttatttaattgctttattgagatataattcaagtactatacaatttacccatttaaagcatatgatttattggttttcaatatatgcacagagttgtgtaactgtcaccactgtcatatacctttaatccagtttccattaggatttggactataatatatatatatatatttgggacagggtctcactctctcacccaggtggaagtgcagtggtgtgattattgctcactctagcctagacctcgtggatacaagagatcctcccaccgcagcctcctgaatagctaggacctcaggcacacaccaccacacccagctaattaaaattttttttttttttgtagagacgggggtcttgctatgtcgcccaggctttgggctgtatatttaacctccatgtcttccacattgttcacccatcataaaaccctcttcagaggtttgtcattgaggataaaatatattgaggttattaaagatattcttcaaatggcagggttttttctcccctatgtaaaaactctactaagtatttggtgatatcataataaaacaaatcagtttttgtgctaggaatggaggaaagaaggtttgagttgtttttatgctaccatgatgatgattattaaaacaaatatctatggctccactgtttgggttttaggggttcttatcttgttggagctggatggccttggaatttatgttaacacaatgatctttactctttccttcctcagtcctgtccccttttaccaggagagtcctagaaatggagtcccagaaacatttgttattggtccaaattcccatgaatgcctttgcttttggcactgctctaggccagtgattccctacatactgaagtcttctggactggtataaaaaactgctgatgcctgggtctccctccagagatcatgattgaattggacttgggtgtggcctgagcctcaggatttttgaaagcttgacaaccactgttattttggtgcacattgcttcaagagacctgctggctccttcttggagtaagaatggaatgcagtgagattaagttaaagtccctggtgtgtcagttcaaaggaggggtatgtaggggtttctccaaatttctcttctttcttgacagctttgtcttagtcctgcctggtgtctccagggtgcttaggcatcaagtttatacagttttgtgataatcctggaatagaggttttaatcccaaacttgactgaaagctccatttgtctcctgcagagtctcagtggttttttgtgatcagagaaggtgctggaggagggaagcattacaaagagcaaacctggtctcagagccctctcctgggctaacctcatccagggccatgtggtgccagtgttccctggcttaggtcatatggcttcacagcaaatagagggttggaaaggtgtggggagagttgaaaggtgatatgtagcgtaaaaaagtcagggagcaggtcttttttggatattgagttcttttagaagattgtccgaggagctctgactcctctgtgctttggtctcttagacctttagtcccatgaccagtctctgcttttgatgaattcttagagggaaccattcctccctttgttctccactatgtgtgaggattatctattatggcattcctgctgagcgcttcctcctctctggttggcatttgctgcctcataaacacctacagatttcctcataagactctgtgggtttgccttagggtggaccttgcaacagaggaatgtgtgacgctgagacatgtgttggttctgcttggaggtaaggagggggatatgcctttgtgtagtgatacaattcctttagcaaagtatttaacagctactgagcaaactctattttcatggcctgtttaaccagacagaccctctaattgggtgaaatgaactaaattaaatgtccttctcctaaaagtcaccagtaacctcagttctaaacctgttggcttgtcctcatttctggcctcacatgaccctgtgtcctaccctttctttctcgccatctgctttcatgatgtcccctctcattattggcctctagcatctcatattacccctttattctcctttgcaggcttcttcttcttcttccttcttcttcgtccttcatcctttctcctccttccttcctccttcttcctcctccttctccttccttcttctttcttctttcgtcttctttcttcccagcaaagatatatttttattttagtgtttagcagcatgacatatgcatatagaatgatagtacactttaccctaatcttcaaaacagaatgtactagtttaccaatgaggaattttggccaaaaatgtagtgtttttcccttccctgtacaggtcaggtatatgtaggtccagcactaatgctgcaccttttgagaagcattactttagcaaaaatctagaaatctttcactttttctgaatctaacaaagggtcttactttctttttttttaaatgtacattttaaaaaataatttcaacttttattttagattccggaggtacatgtacagatttgttacctggatatattgcatgatgctgaggcttggggtacagttgaccccatcacccaggtactgagcatagtacccaataattagtttttcaacccttgttcccctccctcctccctctagtagtccccagtgtctattgttgccatctttatgtccatgagtacccattgtttagctcccacttataagtgagaacatgtgatatttggttttctgttcctgcattaattcacttaggatcatagcctccagctgcatccatgttgttgcaaaggacatgattttgttctttttatatctgcaaggtattccacggtggatatataccacattttctttatgcaattcaccattgatgggcacctaggttggtttcctgtctttgctactgtgaatagtgctgtgccttgtgggcttctcttcattctgcctggacacctggaaggttagtgtcccccaaggctgtgcctgagattgtctcctccctccagttcctgccgcactacctgcccccttaatgggtattggctccttaacactcctcagcctgggtggctgtctcaagctctagccctgcacttttagctgtttagtttgagctggaagactcaacttgtctgtctcaaagatatttcaaactctgctgacctagaactcaccagttcttataactgaatccatctttttggtcattcctgacttcatcctgcagcttcactttcctgataaagtttctagttagttcaattaagtacctgttatgggcagataggagagacaccatcagcctgaattggatgtggcaaaagaggtggatcagtgaaacccttctacggccatggagcatgtatgtcctatcttctctgttcaaattcagggcctctttattttgtagctgtaccattgctgtagctcccactgatccccttgcttttgatctcatccctacaccttcctctccattctgtccagactgccaaaggacttttctaagattggctcttgttgccatgataatagcactaccgtgttcatgggtacagtacttagcagctttaaaaagtgcattcaagggcataagtgacgacgactgtttgtcagtgcctacactgtgctgggattccaaaaacaggtaagctactagatttgttttcaagaagctcaaagtcttcagggattaatataaccagataatataaagacccaagcttcattatttgatctttataatcatctacaaggtagcagggaacgtgttgataacctcatttgtcagataaagaaacctaaggctcaaaaaggttatgcaaataataataataatattagcatatgtttatataacacttgtaaaagccggacactgttccaagcactttatatctactaatgcaatcttcataacaatcctatgacatgtaagtgctctcaccttcataatatacatcgagaaactcatttgtacagagtagttaagttctttgaggtacagagagattacataacttgcccaagatcacatggcttgtaaataggagagctatgatttcaacacaggcagcctggctccagagcccaagcacataaccagtgtgctgcattgccctctttaatttatcttgctatgcagtgtggcttctgttgcctgcagaataaaatttaaactctttagccagctaaaatctccttggtcttggctgcattttcaatacttttaatttagtactttcccagtattaccccagactcattcgattttcatattcttcacagcagtttgtgaacgggacataacaacctctgttcatatttcttgccataaagctatggcaacagggtagcaggataaaagagagcctgtttatttgtttgtttaacatagaggtcagtcagagacagaaatgtttctttttttttagcctttgtcagaaagaaatacttcttttcatttctctgtattggtgggcagatatatatatatttgtctgagttcttctcttcagttttcagaaggggttgtggttctattttcccatttcttgaagtccctgtaggaatgctaaaacccatgtcctaagattacagtttttatagttggtttgttctaatcaatattcagatatagtccacacatggctggttgatacgtcttttaaatcttgttaatctataggttttcctgccccctttttggttgtttccttgcagtttatttgatgagggaattgggtcgtctttcctgtaatttcccacaatttggactttgctgattacgtctttgtggtgttgcttggcctcagtatttcctgcaagtgacagtttaatctaaaagcttgatcaagttagagtcttttttggttttggctagaatacttcctagatggtgcttagagcttcccatcacattgctgggtacttggtactgggtactcacatgaggaagcacctaattcttggttgtttcttgtgatgttacgttttggtcagtggtttcagatgttgttatcttaagtccaccagctttttgcataatggttttaattagctaactttaaatattaacatttgcccttcctggtacattgagttaaaagtgattttcattatttaaatacacactcttgtgtgtatgtatgcatattatgtatgtatgtatgtctatatatgagtatatatcattgttataaaaaataatggcaattaaaattcaattggatattaatgggtttagagtttatgtttgggatgatgaaatgggtaatggtgatgtagaacattgtgaatgtacttaatgccactgaattgtatacttaaaaatggttacaatggtaaactttatggtatgtatattttaccacaatgaagacaaatcaattggaaagggattgtaacacatggaattaaaaaaatccaacacaacataatgagtgataattattgctccctaaaaggagccaaagtgagttggagaatagactgataaagtttctttactgaagaatgctagctaataaaggtagaagctatgctagaattagaaaaaggaaaaaaaattgactttgccacctgcaagtaataattgattcaggcatggatcatcattggatgctgaagcctttcagtaaaagactgttggaattcccattgtctgaatgcatctcctagtaaattacttgctgtttacagaggggaaaaagtacctttacaatggagaaatctgcttcaaccaagtgatcatcagcaaatgggataaactagcattatgttaccgactgatattatgcattgggaagtatacaacatgaacctaaaaatgttcttgccaaaaatatttaatctggatctaatcgtgaggaaacaatcagacaaatccagaaagtaggacatgctgcaagacctctggcttgacttcaaaaatgtcagtgttatgaatgaagaaggctggaataaaggaaactcccaaagagacctgatgaccaaatacaatgcttgagcctgggttaaaaacaaataaagaaaagaatcgaaacagctggaatatggggaccatattaaaagatattgtattagtttgctagggctgccataacaaagtactagagactggatggcttaaacagcagaaatttattttttcacagttctggaagttaaaagtctgagatggagaccccagcaagtttggtttctcctgaggccttctctccttggcttgtagatgggtgtcttcatgtggttccttctctgtctgtatcctaatttcctcttcgtataaggacaccagtcttattggattagggtccccttcatcatctcattttaacttaataaccttttcaaagaccctatcttcatatatggccagtcatcttccgaggggctgggattggaacttcaacatatgaattaggtgtgggggacacagttcagcccataacagttattgaatcatttaaaaatggcttgggtgagataatgatgtcaaggttctgaagggaagtgatctttgctgctgatttattttgtttcctcctagattttgaactcttgaggacaaggaccttctctggacacagatatgcctcagagtaactgttgcatagcattcagacactgctggttgaattgtccatttacttggcatgccaacacatggcaaagtaaagggggaaggagattttctgctgcatgtatgtggtttgttgtaaacctttttctaataatccatttgctcaatcctctccatcccccaacaaagtaatatgatgagaatttggaaatacttgaggagttgtgcatgggtaatcgccaggtgagcacatcatggagaatcagaaattcagaacagaccttggcaggggttgtgctgtcccaaggtagatgaatctctatgactacagaaaggctgcttcaaaaggaggcacctagagaaactctcccttgtgattaaaaaagcccaggtacattagagggcaaaattcccagcaggtccaaacaatgtgttccattgctgctgtttcagccctgctagtctcagtagtaccctgggtcatcagatggcttgaaggacaagagggtgatatcctgtctcttctttgactttgttgtgctcactggcaaggagtttcattcacttctgagaattcacacactcattttattgcaggctgatgttgattctgagtttgaggatgccaacatcttttcattgcctcccagctcagttccagaagtgaaagctcagtcctagattctttttttatggtggttcatgaagatttcagttaatccatttgtggtgtccaacagcaacttgagaagagcctggtcttgacctttgcccaattttctattggtttatttgccttttcacattgatttgttctaagagcgcttgtaaatgaagaacattgcccctttgtcctatctattgcaaattttgttgttgtttttcttctcagttgttgtttaactgatttatattcactttttaaattgttatgtcaaatatttatcatttttttctttatggcttctggattatatggcttctgagtttgtcatgtttgaaatcagcttccctacttaacattacataagaaaccacctgtgcgtttttctagtactttttgaaattctctctctctccttttaaagattaactctgatccagctgtagttcttttggtataagatgaaaggtagggagccagtttaatttttgttgctcaaccccaggagttcgtgacccttcactagtgccacatcatcagctagagagacctgctgctaattcagcctgaatctgctggttcagccttcagaggaaatctgattagttcagaaagccaagatcacctccccacaggggtcaggtatctgctgctgcctcaatcagctaggctgctctgaatatgaagagtaactgggaagcaaggcgctgctagattgtctcaagttgtgctgttttcattcaattgttattctctattctcttacttttagcagatgagaaaacaagaggtcatgctgctggttaacagtggagtcagattttttttttttttttttttggagatggagtttcgctcttgttgcccaggctagagtgcagtggcacgatcttggctcactgcaacctcttgaaccctggttcaagtgattctcctacctcagcctcccgaatagccgggattacaggcatgtgccaccgtgcccggctaaatttttgtatttttagtagagactgagtttctccgtggtggtcaggctggtcttgaactcctgacctcaggtgatccacccacctcagcctcccaaagtgctgggattacaggcgtgagccactgcgcccggccgcagtggagtcagatttaaatgttccattgcaaagctcatgaaataggaaacattctatgaggggaatctggttggagaatcctggaggaagaggcatttgacttagtccttgaaagaacagcatcattttttaaacttctcattatggaaatttcccaaaaagtgcaaaactggaatagtataattaaccctcatctccctatctagccagtagtaatcatcaatttatgtcctcaatattgtttcatttatgccatgccctctttcctccttccatccctacttttttttttttaattaaatttttgtttttggagacaggatgttgctctgtcacccaggctggcgtgcagtggcgcgattatggctcactgcggtctcaaccaacagtcctcccacctcagcctcctgagtagttgggactacaggcacatgccaccatgcctggctaattcatccccatatgtttttcaaagcaaactcagccatcctatctgtaaatattttatgtatctctaaacaagatttcttcaaagcacaatcacaatatcattattatactttaaaaaattataataattcttcaatatcttcaaataggtgttctgtacacattgtacacatttcccgtattgtcttaaaattttttaaatagttgttgaattgtgatgtatataaggttcatgcattacaactgatgtgtcttaattttctttatttttttttttaaattacaaagctacctttatacttttaagccccacaggaataaaaaacactgggaagggctaaccccctcaccccaggagtggcccatagggagagaggctacctgaggggaaggaagtacaaaagggacccaccgcagactcatggcaaagggaagccatcggtgctgggacctgtggtcactacaggaggaaatgcgagtgtggtgggactggctccaggcacacaagtgaagggcaagagagattggagtgaagccacaaagctacttgggttcctccttcttctcgtttgcctttttctgcttctgctgcatgatctcctgagtccctgggggtagagatgatagggcactaggaggtatcagagggcaaaaagaacaaaatgcagagggatgaagggcacaaaagagaagatggaagtggatgggactaagctcaccgtttggctgctgtactcccatcctaggagaagaagaggaagagagctgaggctcaaaaggcaatcagtctccatcctgcagttgcccaagaggtcagaagtctggccacataggcccaaggctctctaccgtttggctgctgtactcccatcgtaggagaacaagaggaagagagctgaggctcaaaaggcaagcagtctccatcctgcagttgcccaagaggtcagaagtctggccacacaggcccaaggctctctattcttacaccagtaagaaggttgggagaagggaggagaaccgggaacagcaaggagggccagaagcactgggctgtcataaccacaggtgtatctgaaatgggaagctccctgcccttgccctgaaggtcagactgggggatgctcagaaatcagactcttgtgtcctaattttcttttgatctctggattctcttgcctgctcaatactgtgctttcttttcctctgaaggacagtgtcacataatggctgaaatcatagatttgcaatcaaattagggctctgccacttgctaactgtgtgacttggggaagttactcaacctctctgtgcctcagtttcctcatctgtaaaatggacataacggtgtctactcctcagggctgttgagagtgtcagtaagctaatgtttgcaaagcattagagtcatgtcaaaagctgtgggctgtggaatagggcccaggagggctcactcaagtgagatggtgtgtcgtctttgagatgagcctccagctgtgcagagagcccctttccttttcctttttgcttccttctggttcttgacgtgcttcagttagatgaggttgatagcaggaatttggacaggtaaggcatatttaatggaagcaacttctttattgtcctttcatttttggcttcctcttcctctgtatttattaaattagcttttctctctcagaagtgtttaactttttatggcattatctgggcttcagcaacttgtgatctcctaagtagagcttttcagcactttataaatacgtcatatactttttatattcctttgttccccatcaggaacatagccccagtcttcagaatagcacaatcagtttttattcatttaaggagcagtagtaatttgacacttgctaatatgtaacaaattatattgggcgtggtaattacaattgcagctggttcctaattatactgtaaccttgatgcttacaaaaattgagactgaattcagcataaaatactggagaataatattctgcactaggcatttctgccttctactgagccatgggcatttatgaatcataatgccaaattaaaaagaatttattttaaattggttacaattacaatgttgtccagtgtctccattcttaaaggtagctttaaagtccccctttttgcttgctaaactctgggaatatccttcaggtattataattagtgtctaaataacctgagctcaggggtcatttctggctgtgtgatctactggtattcatttaagactctttagtacctcagcttctttatttgaaaagtggggatattactcactcttccccttaaagagttttaatgatacagtatataaatgaaataagataaaaagccattagcataatgcctggcatagagttaaggacccagtaaaagttagctggtcattgttatcgttataattaataataagtgatccggctccaaagactgcctctgtgaccctcaactttagcagaattagtgtattaattctcctgccactctgccttatgatagcatgtatcatcatacattttgtaccaaccacttgtcgataagtcagctttccctgcttggggcagggtttctgatttattgggtgttttctcctcggtgcctggcgctgggcctagtacactgcagctttcccataggtgattgtgttgcatggatgagcaagtagagcatcaccatctaaggagtggttgttagctggggggtggggtagtttggcccccaagaggatttcttttagcaacctctggagacagtttcttggttgttgcagcttgttggggaaggggttgctactcccatctagcaggtagaggtcagcttaataacaataatagtaaaatccagaactagtatgtttcaggctcttttggcataacagaacccagctaaaacaccaccattcattcttaactgttatactctgcctcttaatatcagaattttaatgatgatggctttctagtttatgttctacaacagagcagagtgaaatctaacatacatcacaacctactgaatccttctgataaacatctctagtgcctctgaaatgactcgctgatgtaattacccagtgggttaacatttgtggtgtctgatactttataagtcaactgttgagtgaaatgaagttttgccagctgattacatagaaatgttgtggtttgaagaatgcttaacagggcatcttgtctttgtactaatttatatttcagtaacttttcccataatgactgctcttcatttattaggtcgtagggaaactgtaggatgaaggatgagtgactcagtggtttcaataaaaaattattttcttaagtttgagatacctttttcttcttctcaagttaatggtaactgtggttttagggaattccaaactttcttttgcaattactgattgtatcagtcagggctcactcgcagagaacagaatctactctagctggtttaagcagagagagatttattacaggatattaaatggcttacacaatttgttgggaaggtaaagaaacagacttgaggttgagctctaaagaatgacgtctagagtctcaagcagagcaggccaccaagacagcagtgacctcctgtgcagtcacaatgctgcctgccaagtggagagtgtttcaggaccatgtggccactgacatgggagggcaggaggttgccacaggaaaactagacacttccagcaatggtgcgtgcttggcagaaacagcagaaggtgccccccaactcccaaacatttgccaaatctcactcaatttcatctaattgatggcacataggccgcatagcagcaagggagtctgggaattgtagtttcagccttctagtgtctttagtataggaagataaagaaggagggtgggcccctgcttctaagtggttaggttacacccaagaatacttttctttgggattcagggccatctactgcactatttcctcaggttcaaaagactatgcaggactgtttctccttctctctccgtttcctgcttgtcactgcatgcttatttacacccacccacccacacacacacccagaagcttgcttttgatgagctacctctttgagtttgtagttcttatctaaggcaaatatttactttatgatagtagaattttcagtgtaagtctgtgcttgtcttggctttcagatgtttcaggtttgggagggtgactggggaagtattgctgaggaagggctgtgctgtacagttggtgacgtagcagctgaggttgggcctcgggtcctaacgcagttgttctcagtccacccacacatggtaatttcttgagggagctctaaagatatccattctagaaattttcatttgattgacctttggtatggtttgggttttgtaaaacctaaaagcacctcaggggacttgaatatgcagcgaggactgagaacctacatcttataatccgtacattaaaattggacattatctaaagctgtggttcttaaactttaactgcatcagggtcacctggagggcttgttaaatcataggggattgctgggcctcacccagtttctgattctttgggtctgggatgggtgtgataatttgtatttttaaaagttcccaggtgatgctgatggtctccacactttgagaaccattggtctgaagagagttgcctattttcattgtaaatgtcagatttttactgacctgaaagactttattctatattcagcacttccagagaatctactttgtttcctgatctttgccagagttggggttgatctgaggagtaaggtgccctcacagagatggtggtctcacatctctacagcctcccagtgaaagaggagagctttgcttttctttgcattttatttttcaaattagcatttcttattttcgtgtaggttttcttatattcttccccaccatcctctcttagatctgacaactattttgaatacaccattctataccactgtgatttgttaaagtaatgagcctgcaactgtggcttgattcccttgtaagaaagtctgtttaaaaaatattcctacaggtaggaattttctggtgaccccctacctatggctgctctaactcatattaggagagtgaattcatttgtcctgaaagatgacttttgtattcttcttgccatgttctcccctaccccctgcctttttaaaaacaccagttcttgaaattgtgttattgtttttctttttatttctaggatgtacctacctagtatgtgttttgcaaacgctattgatgacttacacaattataaccagtgtttatcttgtcaaaaagttttacatattcagtgattctcaaattttgctcctgtggagcatagactcattgaatcgacctgaaatttccatactaaatttaaataatgatagacttttcccagtttatggaagaaactatgcatagagtttttctgttccaacattgccactttctgggccaggcatggtggctcatgcttgtaaacccagcactttgggaggccaagatggaaggatcacttgaggccaggagtttgagactagcttgagcaacatagtgagactgtctctacaaaaaaattaaaaaattagtggggcctggtgacacatgcatttagcctcagctactcaggaggctgaggtgggaggattgcttgagcccaggagtgtgaggctgcagtaagccatgatcgcaccactgcactccagcctgagtgacacaatgagacccccaactaaaaaaaaaaaaaacaaaacaccaaaaccctctctttttcccttaaatttggaatcagagtaaaatgttatcaaatttcaacaaaattctttatcttgttagcaaataatatttcatagtaatctgtaaaggacccctttcttcttagtgaattactctgtatgtttgaaaaccagttacttgatttaaaattcttgatataaaatttttgttttaatgttggaatccattcttacaaatgcaaattcagaagaagaatcataaagaaaatcaggcagttataacaatagtagctgtaaatatttgcatgctattaatatatgagaaaaaaatgtaacagtgaaagtaagccttctggaaacaatctaaagtttgatgactcttctaaaccccaagaatgaacgaagtctaataattccaggcttctaaagcccaagaatgaactaagtctaataatcccaagcttatgtgatgcaaagtatgcatgctggacagctgttctgaattgactttaaaagggtggctacatttctgtggcttcctttttccagctcatagaacttcctgggtattggttttgccaccaggtagaattcattgaaatacacctttaaaaaactggtacatctcatggtaactttgcattgtcttcaattaagttgtgtaagtgttcttcattcatagcaaatgacacttaaaacaagaagataggaatgggaggtagcagtataaatggaaattccgaacagccacacagcatttgactggtgaataatagatggaattactatagagatgaggcccaggaggctggtagtaatttttctgaatccatcccctgttgaaccatacttatctatccttaaatagaatgtaccaggacctgagccaaattttagtgggcctcagagaaatcttgtggtgatcattaaccatttgctgtacctggaactctgggttgggggtagggtagctgagacaattatcagttaggatggccacaatgtttatttagtggtttggtgagtgtgtttgaagacccatgagtttctcttctcttttgctaatttatcccttctaaattatgagccagtttacccatcatttagatttcttaaggagtaaacatggtagaacataaacatctttggataaataatacaaatagtaatagataccatttattgagcactttaactgtgtggcccttttggtgctaagcactttgtgtaattatctcatattacttttctagctgtctaggactccccattttataaatgaggaaagtgaggctgagaggtcagggcctccaagtcacatggccagtgagtttatgaggttggtcctgctccctatttgaggatgatctgacactaaggccatgttctttttttttaatgaagatggggtgtcactatgttgcccaggctaatctcaaactccagggctcaagtgatcctcccaccttggcctcccaaagtgctgggattataggtatgagccaccattcctgtaagatcatgtccttaatcacagcattggacagacactacacactgttaggagaaattgggagagttttgatttttaggcttgtactatattgcagttatgtaccacataaggatgttttcatcaatgaaggactgcatatatgatggtggctccataaattatagtggagctgccctgtacaggtgttccactttttatcttttaaaaccatatttttaccacaccttttctatgtttagatacttgttttacagttgcctacagtaatcagtataggaacatgctgtatagatttgtagcctaggagcaataggctatctcatttgcctaggtatgtagtaggctacaccatctaggtttgtataagtacactatatgatgttcacacaatgatgaaatcacttaacaatgcatttttcagaatgttatcctgttgttaagtgatgcatgactgtattatattgccagctaatgcaagttatcaacactttgaagctgcctgtaatgtgggtctgtaggaaggccactacggtaagagatggaatatttgggatctgatctcagctcagaaaacatttagaaatgtcagcacagattggcacttaatctgactttttgggggaaataattgatgctttctgagctttggtttcctcttctgtaaaattagggcagtaatatccatcttatctgactgatttgcagtgagaatccaacgagataatagtcttgcttagaaaactgtaaatgttaggcaacatgccttataagtgttgggtcattctctgtctttgttttgatttgtgttctctgccctagaccctgagaaggttacaaagtgaacactttttttccccctttgaggtgtagttctgatggggagcactgaatatacatttcaggatccttaagcagaaatgtgctatgaaaattgagggcaggggaggttcactctgaaatagcattgcccaggcaagaccttacaaagttcatggcataaagaattaattctattttagaattacgaagaatacttcattttgtggaaaatttattttgcttttaagaggaaaacagttaagaacttagggtaccatatgcttttgaaaaaagtgttatgtacttccatgagatgtgggactcttaccatcaaggaggagatttttctgctcttaaagtggaggatgggggcattttatgctgtcccatcttctcttgtgttcgtcctaccctacctttctcagaatagagacctgagaggagggagtcctctctgaagcttttagggcagcagagtcattcatcttaggttaactagcagtacattttcttctcctctattgaacagcagagaacacttactaattcaggatttttaaaaagattaaaaattcatggctgggcacagtggctcatgcctgtaatcccagcgttttgggagtctgaggcgggcagatcacctaaggtcacgagttggagaccagcctggccaacatggtaaaaccccatctgtactaaaaataaaaaattagccgggcatggtggtgcatgcctataatcccaactacttgggaggctgaggcaggagaatcgtttgaacctgggaggctgaggttgcagtgagctaagactgcatcattgcactccagcctgggcaacaagagtgaaactccatctcaaagaaaaaaaaaaaagtattacaaattcttatgaatagccttggtggttacaagcactcagctgaaatgaagagttatcagtcttgctttgggaaacaaggtgaccaaccatctggtttcagaaagactactcccattctagtgattagttaataaaattattcctgacagtggagagcctaggagctcaggcagttccatatttagagacagagaactcattgtccaaagatctcagaacagccttcactagctcacagaagggatttaggacaatttgcataagtttccctgtggatagcaacatgggtccagtgttgggtggttccaggaacctctccttggcttcatcatggggtggctctgtgcttggtgggaacccagtctcatgatgttttttgctaggaggattgggtgttgggacattgaataaacccactgtttggttccacataagggctcttttgtgttggcctgaggaagccatgttgaagtttgtcttgcttttccccagcaatgtttttggactttgtggcctgcagaattaagcacaacacccattctgagctaatctgtcaatttttgctcttcaaagataaccacagccacttgtatttctaaaatatgtagaataatatcatacctttggagacctatgatttattaattaaaaactgaggagaggaggagaggttctttggcatgcccaggtagtgaggtatacatgcctgttcatggtgaaactgtgagaagtaactcccttgagttaatatgatttccctagttcactgacttctttaagaaatatgttctcttggctgggcacgatggctcacgcctgtaatcttagcactttgggaggctgaggcgggcagatcacttgaggtcaggagtttgagaccagcctggccaacatggtgaaaccctatctctactaaaaatacataaattagctgggagtggtagtacgcgcctgcaatcccagctactcaggaggctgaggcaggagaatcgcttgaacctgggaggcagaggttgcagtgagccgagattgcaccactacactccagcctgggcaacagagagagactgtctcagaaaaaaaaaaaagaaatatgttctcttgcatagttgacaaacatttgtttacttaaattctcctgtgaaagggcatggtttacactggattataagtaaaaaatgacaggtgtttgcaatgtttcaccttttctttttaagaaatgatatacattcaacattagatattaagagattttgctactggttccttgcataaaattttatcattttagaagctgcataaggagtctaatttaaaatgggaagggggcatagtttatgcactggggcaacatggtatttaagtacaaaaatgaaatgcactaatttttaatctgagatttattttcctttagtcggctagcttgatttctcagctttgttgtaataacataaacatttttatgtttatttataggtggctttaaccaagagagcagatccagctgagcttagaacaatatttttgaaggtcagtataaaggaatctattttgtttcttgtttgatttgtgttctataacttttaaatattattttcaaacagctctttatttcgttgttatattttgaaaaagtcccaaagtgtcagcccggcacggtggctcatgcctgtaatcccagcactttgggaggctgaggtgggtggatcccctgaggtcaggagtttgagaccagcctggccaacatggtgaaaccccatctttactgaaagtaccaaaactagccaggtgtggtggcacgtgcctgtaatcctggctattcaggaggctgaggtgggagaatcgcttgaacctgggaggcggaggttgcagtgagctgagatcgtgccactgcactccagcctgggcgacagagcaagactgtctcaagaaaaaaaaaaaaaaagaaaatcccaacatgtcttaagaggggagagccttacaaatacgtctgctttttaaaatgtaggtgactgtgatgacaacatggcttatattttaatttcttttatctcatgtggtgtaaggtatgtgaataaaagcggttgctggagtattcagttttgcaacccatttacctttccaggattgacccgtatagctttttctcctaggaagtttaaagctcattgtaaacatctcagtaatccttcactcatccatgggactatactgtctctccctggtagaagcctattgttgtggtcatcatcattatcatcactttatgatgactgcggtatcctgagaggaggctccagtatggataatactagatactagagcacaacagacaccatggaagtttgtgtcttatactggcatcttatatttccacctattttgtgatagtgggcagtgaatgattaatagaataaaagtctgtctcaggttccagacaccgaaacacctttatgttattcagctgaaattaaagtactcagaaaagaaaaggccacttttgtaagataatatacacacatataatatatatgtatatatacacacacatatatgatatattattaataacatatattaatatacacatattttatatatatatgtttttctaaacattatgaaaaggcagctgagttgtatggaaagaggaccagggtgtcaaatgagaaatttgatgtgtactgaatatggtgtagaaaggtattaaatctatgaacctctctttcctcatcacaatgtgttactattaaaactaattgagacatcaaggactttgaacatggacaggatatttgatattaaggagttggtattaatcgatgtttaggctgataatattctcattatgggaaatatagagtctatgttttagagatatacactgaaacatttttacagatgagactaccgtttctgagatttgcttttaaataatccagttttgttgagttgaggaaaatgagtaggcagtatgatgataacttttgaaattgggaaatggaatattgggtttattacactgttctctctactttgtatatgtttgaaaaattttcttttcttttcttgttttctgagacagagtttcactcttgttgcccaggctggagtgcaatggcgctttctcagctcactgcaacctccacctcccgggttcaggtgattttcaggctcctgggtagctgggattacaggcatgtgccaccacacccggctaattttgtgtttttagtagagacggggtttcaccatgttgatcaggctggttttgaactcctgacctcaggtgatctgcacgccttggcctcccaaagtgctgggattacaggtgtgagccaccacacctggtctgaacatgttcataataaaacatttttttaaattgtaacgattcagtgaggtaacttatatgaaaggtgtcctgcatctgatatgtgttatgtattgattcagtaaatgcttgaaattaagtaatgatttaagtaaaggagaaataaagactccaaaagcaaatgaattaaaagcagggatagttttgtggggaggaaaaaaaaggacacatttgtaaggagatttagattatacataaaaaatcaggattctggacacctgtaatcccagtgagaggctgaggcaggaggatggcttgagcctaggaatttgaggcttcagtgagctatgaatgtgccaccacattccagcctggatgacagagtgagaccctgtctcttaaaaacaaagcaatgttctttataaatttgtttttagcccagaaatacagtgtagagtttcttttttttctttttttttttttctgagacagagtctcactgtgtctcccaggctggagtgcaggttgcgcatgtcagctcactgcaacctctgtctcccgggttcatgtgattctcatgcctcagcctcccgagtagctgggattataggcatgtaccaccacgcctagttaatttttgtattgttgttattattatttttttattatactttaagttctagggtacatgggcacaacgtgcaggtttgttacatatgtatacatgagccatgttgatgtgctgcacccattaacttgtcatttacattaagtatatctcctaatgctatccctccctcctccccccaccccacaacaggccccagtgtgtgatgttccccttcctgtgtccaagtgttctcattgttcaattcccacctatgagtgagaacatgtggtgtttgtttttttgttcttgcgatagtttgctgagaatgatggtttccagcttcatccatgtccctgcaaaggatatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgcctttacagcagcgtgatttataatcctttgggtatatacccagtaatgggattgctgggtcaaatggtatttctagttctagatccttgaggaattgccacactgtcttccacaatggttgaactagtttacagtcccaccaacagtgtaaaagtgttcctatttctccacatcctctccagctcctgttgtttcctgactttttaatgatcgtcattctaactggtgtgagatggtatctcactgtggttttgatttgcatttctctgatggccagtgatgatgagcattttctcatgtgtcttttggctgcataaatgtcttcttttgagaagtgtctgttcacatccttcacccactttttgatggggttgtttgtttttttcttgtgagtttggctgagttctttgtagattctggatattagccctttgtcagatgagtagattgaaaaaattttctcccattctgtaggttgcctgttcactctgatggttgtttcttttgctgtgcagaggctctttagtttgattagatcccatttgtcaattttggcttttgttgccattgcttttggtgttttagacatgaggtccttgcccatgcctgtgtcctgaatggtattgcctaggttttcttctagggtttttatggttttaggtctaacatgtaagtctttaatccatcttgaattaatttttgtataaggtgtaaggaagggatccagtttcaactttctacatatggctagccagttttcccagtaccatttgttaaatagggaatccttccccatttcttgtttttgtcaggtttgtgaaagatcagatggttgtagatgtgtggtattatttctgaggcctctgttctgttccattggtctatgtctctgttttggtaccagtaccgtgctgttttggttactgtagctttgtagtatagtttgaagtcaggtaacgtgacgcctctggctttgttcttttggcttaggattgacttggcaatgcaggctcttttttggttccatatgaactttaaagtagttttttccaattctgtgaagaaagtcattggtagcttgatggggatggaattgaatctgtaaattaccttgggaagtatggccattttcatgatattgattcttcctatccatgagcatggaatgttcttccatttgtttgtatcctcttttatttcattgagcagtgatttgcagttctccttgaagaggtccttcacatcccttgtaagttagattcctaggtattttattttctttgaagcaattgtgaatgggagttcactcatgatttggctctctgtttgtctgttattggtgtataagaatgcttgtgatttttgcacattgattttgtatcctgagactttgctgaagttgcttatcagctgaaggagattttgggctgagacgatggggttttctaaatatacaatcatgtcatctgcaaacaggacaatttgacttcctcttttcctaattgaataccctttatttctttctcctgcctgattgccctggccaggacttccaacactatgttaaataggagtggtgagagacggcatccttgtcttgtgccagttttcaaagggaatgcttccagtttttgcccatttagtatgatattggctgtgggtttgtcatagatagctcttattattttgagatacgtcccatctttacctaatttattgagagtttttagaatgaagtgctgttgaagtttatcaaaggccttttctgcatctattgagataataatgtggtttttgtctttggttctgtttatatgctggattacttttattgatttgcgtatgttgaaccagccttgcaccccagggatgaagcccactttatcatggtggataagcattttgatgtgctgctgaatttggtttgccagtattttattgaggatttttgcatcgatgttcatcagggatattggtctaaaatgctctttttttgttgtgtctctgccaggctttggtatcaggatgatggctggcctcataaaatgagttagggaggattccctctttttctattgattggaatagtttcagaaagaatggtagcagctcctccttgtacctctggtagaattcggctgtgaatctgtctggtcctggactttttttggttggtaggctattaattattgcctcaatttcagatcctgttattggtctattcagggattcaacttcttcctggtttagtcttgggagggtgtatgtgtcgacgaatttatccatttcttctagattttctagtttatttgcgtagaggtgtttatagtattctctgatggtagtttttatttctgtgggatcggtggagatatcccctttctcattttttattgcgtctatttaattcttctctcttttcttctttattagtcttgctagcagtctatcaattttgttgatctttcaaaaaaccagctcctggattcattaatttttggaagggttttttgtgtctccatctccttcagttctgctctgatcttagttatttcttgccttctgctagcttttcaatgtgtttgctcttgcttctctagttcttttaattgtgatgttagggtgtcaattttagatgtttcctgcttctcttgtgggcatttagtgctatagatttctctctacacactgctttaaatgtgtcccagagattctggtatgttgtgtctttgttctcattggtttcaaagaacgtctttatttccgacttcatttcgttatgtacccagtagtcattcaggagcaggttgttcagtttccatgtagttgagtggttttgagtgagtttcttaatcctgagttctagtttgattgcactgtggtctgagagacagtttgttatagtttctgttcttttacatttgctgaagagggctttacttccaactatgtggtcaattttggaataagtgccatgtggtgctgagaagaatgtatattctgttgatttggggtagagagttctgtagatgtctgttaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactcaggacttgctttatgaatcttggtgctcctgtattgggtgcatatgtatttagaatagttagctcttcttgttgaattgatccctttaccattatgtaatggccttctttgtcttttttgatctttgttggtttaaagtctgttttatcagagactaagattgcaacccctgcctttttttttttttttccatttgcttggtagatcttcctccatccctttattttgagcctatgtgtgtctctgcacgtgagatgggtttgctgaatacagcacactgatgggtcttgactctttatccaatttgccagtctgtgtcttttaattggagcatttagcccatttacatttaaggttaatattgttatgtgtgaatttgatcctgtctttatgatgttagctggttattttgctcgttgcttcatacagtttctccctagcatcgatggtctttacaatttggcatgtttttgcagtggttggtaccagttgttcctttccatgtttagtgcttccttcaggagctcttttagggcaggcctggtgttgacaaaatctctcagcatttgcttgtctgtaaagtattttatttctccttcacttatgaagcttagtttggctggatatgaaattctgggttgaaaattcttttctttaagaatgttgaatattggcccccactctcttctggccagagatctgtcgggagatcagtttctgtcgagagatctgctgttagtctgatgggtttccctttgtgggtaacccgacctttctctctggctgcccttaacatttttttccttcatttcaactttggtgaatctgacagttatgtgtcttggacttgctcttctcgaggagtatctttgtggcgttctttgtatttcctgaatttgaatgttggcctgccttgctaggttggggaagttctcctggatattatcctgcagagtgttttccaacttggtttcattctccccatcactttcaggtacaccagtcagacatagatttggtcttttcacatagtcccgtatttcttggaggctttgttcatttcttttttactcttttttctctaaacttctcttctcgcttcatttcattcatttgatcttccatcactgataccctttcttccagttgatcgaatcggctactgaagcttgtgcatttgtcacatagttcttgtgccatggttttcagctccatcaggtcatttaaggacttctctacgctggttattttagttagcctttcgtccaatctttttttcaaggtttttagcttctttgctttgggttcgaacttcctcctttagctcggagaagtttgatcgtctgaagccttcttctctcaactcgtgaaagtcattgtccgtccagctttgttccgttgccggtgaggagctgcgttcctttggagcaggagaggtgctctgatttttagaattttcagcttttctgctctgttttttcccccatctttgtggttttatctacctttggtctttgatgatggtgacgtacagatggggttttggtgtggatgtcctttctgtttgttagttttccttctaacagtcaggaccctcagctgcaggtctgttggagtttgatggaggtccacaccagaccctgtttgcctgggtatcagcagcggaggctgcagaacagcaaatattgctgaacagcaaatgttgctgcctgatctttcctctggaagcttcatttcagaggggtacccggctgtgtgaggtgtcaatctgcccctactggggggcgcctcccagttaggctacttggggctcagggtctcacttgaggcattctgtctgttctcagatctcaaaccctgtgctgggagaaccactactctcttcaaagctgtcagacagggacatttaagtctgcagaggtttctgctgccttttgttcggctatgctctgcccccagaggtggagtctacagaggactcctggagctgtggtgggctccacccagttcgagcttccaggccgctttgtttactactcaagcctcagcaatggtgggcgcccctcccccagcctcactgccaccttgcagttggatctcagactgctttgctagcaatgagcgaggctccgtgggcgtgggaccctccgagcgaggcgcaggatatattctcctggtgtgccgtttgctaagaccgttggaaaagcgcagtattagggtgggagtgacccgattttccaggtgccgtctgttaccccttcccttggctaggaaagggaattccctgaccccttgcgcttcctgggtgaggcgatgcctcgccctgcttcggctcacacttggtgggctgcacccactgtcctgcccccactgtccaatgagccccagtgagatgaccctggtgcctcagttggaaatgcagaaatcacctgtcttctgcatcgctcacgctgggagctgtagactggagctgttcctattcggccatcttggaaccatccaccaatttttgtatttttagtagagacgggtttccccatgctggccagactggtcttgaacttctgacctcaagtgatctgcctgccttggcctcctaaagtgctgggattacaggcacgagccaccatttctggccacaatacagtatacagtttctaagttggaaaaggattctggaggatgaaagtccagaaaacagaaaagcatttgttccttacctaagctgatctctatggttgtgcatgttgggaccaccatggttggaatgaggtctgtatgagagaaccagagaaggtcttcgtatgtgcatttaaggtgtgttgatattgtaaaactccagtgacagaaatctgaaagatcacttgcagaaaagtaactaagtgggctgccaaagatcctatcaaaatggaaagtagctcattagcttaagctggtaaagaagtcatcgttctttgaaccgaggacctatctgttacttctgttttctaaacaagcaagagtggtgggcatccttctgacaggaagtgggaacaccatagagggtgtctcaatacatggtgcatcttacaatctcactggttggtgtgatccattgataagactccacttaaaggctgtgtccacctttcgaggaggccacatggtccctggagaagctaggctgagaccttagtttggaacgatgtatctttgtcagctgctacatccactttcagcagccagcaggactatactgggggagagtctaattgatcaggtagacctagagagggtgagaattcatgcagagttctggagagacacctgtagtgtttctgtttaagtgcacttgaaggccgagggtggaatctttggtataaatggggaagtactctcttcccttggggtggctgggactatgtgacttttgagtaacagtttgtgtggcttggagtcctaagagatgacgtcagggggaccatacctgaagaaaacagcagtcagcagtttgtggaaaggattgtggatctggcaaaagttctggtgatctcaccaggcctggatagtgtggtaccaacccaaatctgccttggcttagcatgctaaggatgtcaggtttaccatttatcacagatggtattgtggtgaggggaagaacgggaaacacagcaatgtggggaccgtgccaggccgagcttcttagttaattatggatcagcagtaagcattctgtaaacctgtctactttgctgattttctgtgactttttcctgacttgactttcttcctagtaaaaattccatgtgaaatatcccagccttctctctgctaacctgtgtaaagagaggattcttctttagcttgggaggtggaagggagcttcattgcagccttcacaccaggtgtgatggtagcaggaaagttggcagctctgtagatcagcgacagccagtggaactgagccagataaggaaagagggctcctaggggattaaaatgagcccaattctgcccttttcatttgtttgagaatttagaatcagttccactgtttttttgaaggtacctagatacagtgtcatggactgggtgtgtatcaatgcatacatcatggctcctgtccattaatatcagagtgagaactgtgtgtaagtgtaaaaaaccccagaagccatgatatgattgataagtagtgtacaggattaattagcagaagatggtgtggtctaattatatctttctatggagagtcattaagttatggagaggtggtaatgtttgaattacgctcgaagatgagtaggtagagaagggtttgttggcaatggaagacctttttaggcaaagaaaacaacacatacaaagtaaagagctgtcagagtgccacaggtgtggagggaatggctaaacacttgggctggctcggggcacaggatcctgggtggtggtagtcaggacaggacttgttataaaacatgtggggctaaggcatacgacagattttttttttttttttttttgagatggagtcttactctgtcacccaggctggaatgcagtggtatgatcttggctcactgcaagctctgcctccccaggttcatgccatcctcctgcctcagcctcccaagtagctgggactacaggcgcctgccaccatgcccgggtaattttttgcatttttagtagagatggggtttcaccgtgttagccaggatggtctcgatctcctgacctcatgatcctcctgccttggcctcccaaagtgctgggattacaggcatgagccaccgtgcctggccaacgacagatgttttcttatggaggatgttcttgtggcaagtgtcaggtaatgtttcatctagatgtagaagttaaagtctaggaagtcagttttgtttctagtcttaacgacatgcgtttttctgtttgcctagtacttttggtgttgcttcctgttagtttaaacagatgtgtattgagtgcctgccatttaaataaaacaccaggaaactctgtggtgagtgggaggtgcaaaagatgtataacaatgaccacatcttaaaggagctcagattttatataagagaccagatggataggcatgcaggaggtaacaaagaatcttaaagttggcataccccaagggcctgcgttgtggttaaagcaaatgctgtaggaggtggaaggagggagcagcccccattgtggagagtggtcagggaaggcccttaggagagagaacttggggagtctcagggacaagttggagaggcgacaaggaacacgtttgagggaaggcctggagatgagttgaggagaaaacaacctctgcaggttgaaggagtattgctcatcctttaagtgtttatttaaatacaactctggctcaaagtatgctgagtatcacagggtgtgggtgacaggattggaaaggtaattgggggtttggaattccactaaacagtaggaagcattcgaggttttttgacgaggagatgggtgtgagatttgattggtgcagcaaggccacaagttaggcagccttagggttgcggcagcaggaggaatggagaatggcaagatagagtcactttgaaagaatatttgattaagatggctgattttttataatggatgagagagagcagagagaaaatacggtctgagtgcagagaggtgccagtaataagaatagagaaagtgagagggagccagtagctcgagggaggaaaagagatgatgcgtgctattgtattagtaacagagaaagtgagagggagccagtagctccagggaggaaaagagatgatgcctactattagtaatagagaaagtgagagggagccagtagctatggagagcaaaagagatgatgtgtactattgtattagtctgttctgttctcatgctgctaataaaggcatacctgagactgggtaatttatcaggcaaagaggtttaattgactcacagttccacatggctagagaggcctcacaatcatggtggaaggcgaatgagaaacaaattctcgtcttatattgtgacaggcaagagagcttgtgcaggggaactcccatttataaaaccattggatcttctgaaacttatggggagaccgcacccatgattcagttatctccacctggccccgccctggacacatggggattattacaattcaaggtgagatttgggcggggacacagccaaaccatgtcaactgtttagaagtatatagtctcaagtaactaaatctctgtagcgaaagatgggaaaattggggaaaagggctgaatgagaaacagaagacatattacagagtaacatagtgaattacacttggatttttataattgttttgtcagcaaaagcatgatatccacttttaaaatgtctgtaggcaaattttgaaaaacagttaattctgtttttggaaactttttatcacatcaattttatatgcattgaaaatttaaaaggcagatacataaacaaaagtaacttgtgatctttgtgtaggaagatagatatttatatatttatttatctctcagtctatgtgtctctctgtatgtatataattttttttccccttaggagaaaaaaatactgttttctatctagttttttcccttacctgctatgttacaaatactttttcctataattcagtgtgcttctatattttttttatttttgtaaattattttgtttcttccatgatgatttagaggaactacttttaaaccagtacaaatatgtcataaataatatctggccatcttctaaccagttgagtaatttcttgcgcagtaagttacctcacatcttttggtaagcaatacgttaaatttgattagtaaagacattatacagttaattaggacacaattaaaatttgctttaaatatttctttgagggagtggacaccacatttttacaatccagaggtctttttttttttttttttttttttttaaacacctatttgccatgaagtcataggaaatagcttccagcaatgcaagctccttcccgtgagttctcacaaagtgtgcttctctgcgtggagcaggctgacaccaggtacaccttctttttctgatcatttttcttcatgcatttcaggaagctatctcagctcttagagtgcttaatgtgcccagcacacacattgattctcttagcaagagtcttgcccttaacttgttgtttacaacagtgccaacagcatgctgggggcattgtagactcctctacttttgccatggtaacacttgtaaagcattcctttttgaacagtactcattcccttaatgtctacaatatcacctttcttatagatttgcatatatgtggccaaaggaacaactctatgttttctaaaaggcctacagaacatatattgagtgcctctcctctttccctttgtgttcatcccattttggtgaattactggaagatggtggttccagctgaaaggaaccctactacaatatttttaatgctgcataatattcctacatatggctgtttctgttttgccctaacttattgaagcactatttaattattgaatatttagttgtttcctgtgctttactatcatgacagcactgtaatgatagtattgtacctacatttttgcatatagctagcattattttcttaggataaattcctagaagtggcaccattgggttagaatgggtttagaacatattaaggcttgtgattccccttggtagactgcctctcatgaaggttatttcaatatttattttgggtgggaacacggaagtgttcatttcctacattatatcaactcagattattatgagtttttgttgcagcagcaacaaaaaagactttatgccaatctgttggttgaaaaattgtatcttatttaaaattttcatttttaaataaatagagcaatatgtttattggccatttatgtttcttaaatatgtttttaactttattgtgacaattttcagacatacagaaaatagaatagtaaacacccacataaccaccatctgatttaaagtaatacttgtcatgttagtttatacatttttttctgatttatgttaataaatataacttagctatcactataattcaccctaaataatttagcatagagcttcaaataataaaaacaatctcctacacagtcataataccattgtgcacctaataaagttaatgataattccctaatataaaatacccaatccagatgcaaatccttaaattatattttgttccatccctataacagggaatcaaagtaaaggatgggcagatgcagtgacctgttgtgtgcaccttctcagtggttggaaaacaatgtaggggatttgtccttcagtcccaggatatgagtgattcatgacaaaatgggtagctggatgattatggttctaccctggctcattcacagcttacaaacctttatcaatttactgtgactgatggtgagcaggccagataggacccctgccctcggggtatgggcatttgtagtgataggttccttctggtttcctttgctgtcatcttcactgagtatggtggtatttcttggtgatgacaataagtattatacaaggttgcatgaggaatcctaaaactcttcccattttgcaggtgtatgtttaatcataataaaactcctgaaaattgcaagggaggaaggcttcagctcactagtgaaaaatattcccaaagaaggattaatgacattttaaagatgtggtggatataaggatatagtccgttccccctatagggaccctctgctcactgctgcagggagagcagagctgcatttatcactaccctcatacatatttttattatggtctgcctctgtccatcaatcctaaggagcaacctttgacatgtttacttaaatcacagagcagactgcccagccgtggtgatgagcttgttttaaaaactggagaaaactatttctgtgcccagattaacatgctcttatatttaagaaatgatttctttattgcatctaaaaaaatgaagctgataatatctctcaaagacttctaaaatgtaaactgttgaaatataaattgaatgcatacatcacaaatgtacagccatgaatactcagaaagtgagtaggcccatgtaacgagcatcccagaggccctctgatgccccttctgatcagcacccaccaagggtaaccagttgtctgaattctggtcactgtatgttaaaactaactgtatgtaagttttgcctgtttatttcactttgcgtgaatggaattatacgctaggttttcttatgtttcttttcttttacccttaggattcgtctgttgtcatatgtagttggagttagtttattcttttttttttttttttttgagatggagttttgcacttgttgcccaggctggagtgcaatggggcggtctcagctcactgcaacttctgcctcccgggttcaagcgattctcctgcctcagcctcttgagtagctgggattacaggcctgtgccaccatgcctgggtaatttttgtatttttagtacagacggggtttcaccatgttggccaggctggtctcaagcgcctgaccttaggtgatccacctgccttggcttcccaaagtgctgggattacagatgtgagatgccgtgcccagctggagttagttttttctcattgctgtgttgtattccattgtgtgaattcaccacaagccattaatgtatcctactattggttgacatttgtgttatttttagttttttggatactacaaataatgccgctgtgggcattttcacatagtttttgtgtatatgcacacttctgttggtgatatacttctgattgaaattggtgggcttgtggttgtatgttcagctatagcagatactgcccagcatttttctaaaatggtttactcctttattctcataccatcagtgtgtgagagtaacatttgctccacatttttgccatcacttattattctttttcgttatcttgggggtatggcatggtattgcattgtaggctttttgttttatgttttgagacagggtctcactttgttgcccaggctggagtatagtgatgcaaacatggctcactgcagcctcaatcttttgtgctcaagcgattctcctgcctcagtctcccaagtagctgggactacaggtgcacgttaccctacctggttaattttttattttttgtagagatggagttccgccatcttgcccaggctggtcttgaactcctgggctcaagcgatctgcccaccttggcttcccaaagtgctgggatgacaggcatgagtcagtgtgccctgccttgcattgttttattttgcatttcagtggaatttttttagggagcagcaacttgataatgattctaaaggtcatttgtggaaaatcaaggagtgatcatggccaaaaaaatttccaagtgtaaaataattcaatgtcttttttaaacctttcattcttttaaaaaaatatttatttgaacatgtttcactatctaccaggtactagtctgggaatttgaggacacagcagtaaaaatgagagaaaaaaaattctgtcctaacagaactttccctctagttatagcatgtaatcttgcaagagtagacgagacaattgaaaaggatggtcctgaaacatctctgactgcagtgatgacaagagctgtcattcgatcccagcattctcccatggagcgtaggtcagcctcagaatacatgttggccctaggaagcctttgccagttcatcagaactggtactgcagatggagccattttgtcacgcctttccctggtgaccatatgataattaagtatgtgataaacatggcatcctaaagacctggaagagagaatgatttgctttgtgttcgtgggacaaccaagagattaagtggaaaaattaaagttgggggattcttaccttagatcacacacaaagataaagtactaatgtactaaaacttaaaggtaaaagataaacctactttaaaaaaactcagataaactctctgatatttagtcttgaaatgaagaaagactggtgatatggcttggctgtgtccccacccaaatttcaccttaaattgtaataatccccacatttaaagggtggagccaggtggagatcattgagtcatgggggtggtttccctcatactgttctcgtagtagtgaataagtctcatgagatctgatggttttataaatgggagttcccctgcacaagctctcttgcctaccgccatgttaagatgtgactttgctcctcattcgccttccaccatgattgtgaggcctcccagccatgtggaactgtgagtccattaaacctctttttatttataaattacccagtcgcaggtatgtctttattagcagtgtaagaacagactaatacagctagtgtctaagcttagaaaagtaatggaagaaatttcaaaggagaaaaaaattctatacactcaattatataaaaatatcaaactggaaaaatatttgcaacaaatataatagaccaaagtgagtaaagggcatgttcacacactgttggtgggagtgtaaattggtacaatcttttccggagagcagtgtgataataagtaccaagagcccagaagttcctctcctttgactcaacaatttctcttctgggagcctagcctttgaaaattgccaggaatttggacaaatgttatattcaaagcttactaccttagctttatttaaaaatacaaaaaactggaaatgtctactggtaggagaaaagttaaattgtatagtaaaataaattattcactatcaggggcaaacttaggtataattactaagtcataagattgctgtaattagcagtgatatttcctttatattttcatcttgttttggctcagttaggaaaatcaaaatataattctttacatgtccaaaaagccgaattaaatgctaactgaagaatagtaggatcactggggcatctttgagcctttcccttgtagtgtgctaaaaaaaatgttaactgtaagacaatactatagaacatttatttaatataaagtacttattgtgtatagggcgttgtgctaagtatatgacatgagtatctcatttaaatatttctagcatcagtcttatgaagctgtaatgttattctattcattttgcaaatgaggaaccagaggtaccaaaagctttagttacttacctgaggccattcaagtggtaagaggcacagtccagacccgtgggatgccaaagcatattactactgagtatctgagcaaagccttagtctgcattggaattaaaatgtagaaataacaagtgacttttaaaaacagttttaatcaggtttaactcagattagagagagaggggagacactgccctggcacttcactgcgcaccctccatcactatggctaccagtgtggttcttatcacccagctaggcttgttcttgtagatgcactatccttgcctcctcagtccccaaaccactgctttgtccccaggatcaagaggccgtctcctgcttcataaggacaccacatgatcccatgtcgtttctcagcatttctgcccttagggctccatgcaacagaaattaatgggctctctcttatccaggctggagtgtatcacattaaaggccagacctaggagaacactgtgaggaagcgttgtttgccacctaattcttactgagcatttctgcatggtaatgccttagaatggagaggacagtaactagagcagcatttactgcctccctccataagattgcccaagatgacacgcacttagtagtttgctgtccagcttagcttgtttgccatcctttcttgtatcattgatgctcttaaagcaggaatggggcaaaggaattaggttgtttgcctccatgacttcgtaattccactttttttttttttttaaaaagctatgtgcctttgctaaaaaacaagacatagtttgtctttccaaatttctataaaccagggtttctgaacctggacactgcccacactttgggctggagaactgtctgttgcagggagtcatcctgtgtattgttggatgtctagcaacatccctggcctctacctgctggagccagtagcacccttcctcacatgttatgacaatcttaattgccatcagatattgccaagtgtccctgtgggaaaacattgctcccagttaagtttataaacataaaacttgacttgttttttctttgaactgttgggagataatggtcattatgaagcgtacatgatcatatctgatattttatcgtttggatattttcaactttttcacatatcactctcatgattatatactgttgaaaatcaaatatataaaatactgtttttcttttttttaaacagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatgggtatgtttatttttaattattttatttaattctttttgtttgaaacagctttcttttgctctaatgaccaggaagtcattaaatgtataccttcccatctcttaggaccattttctgtacttactactattattattacattatttgagtaataatgtagttccttcaatcattgtttcaagttggggattcaatatgtatatatttgactcttttaaagaatgctttatcgtatcagagaactattattgtcaacaaggtggtgatgtgcagatgtatgagagtatttatatgcctttggtatttttcaaggcagctgtaaaattgtgagtaaatgtacaacatagctctatgaacgttacttttctataatctttctttctgagcaaatcgcctttaaaaattcacaggtgattccaaagccccaagaaaggcactctgcaaaagctagaggaaagaaactgtaccatatagaatcaaataggacacgttgcagaatgcctttggattctttttttccctaccagtcttctctgcttccattttgttggaacttttttccctccttcttttgaggcaggttctcactctgttgctcgggctggagtacagtggcatgatcttggctcagtgcaacttctgtctcccaggtacaagctatcctctcacctcagcctcctgagtagctggtatcaaagccgtgcgccaccatgcccagctaatttttgtatttttttgtagagacgggattttgccgtattgcccaggctggtctcaaactcctgggctcaagccatccgcttgcctctacctcccaaagtgttgggattacaggtgtaagccactttatctggccttctgcttacattttaaaaatgggttttccttaagctgtataagattgcaatggcttttaccattacacgaagaattttggactctgaactcttgctaatcaaacaccaatgtctgctaatagccaaagtataatgtacaagaactaaccttctctaggtaaactgtaaaggaccttgccttcttccttctctaggtaaactgtaggagactttgcttctgtccctgctgcttgccagcacccttttgacagattgcagttacctatcactctgaggtggagttctctagctctgaattttctctatttattggaatcttcatgtgtctgattttcccacatgcagcagtttgagatataacccatgtataatgtctttatgtacttcgaatactctcagttttcactagcactttccttttcttatttatgcacttgtcacccaatttttttattatactttaagttttagggtacatgtgcacaatgtgcgggttagttacgtatgtatacatgtgccatgttggtgtgctgcacccgtcaactcgtcgtttaacattaggtatatctcctaatgctatccctccccactcccccgaccccacaacaagccccagtgtgtgatgttccccttcctgtgtccatgtgttctcattgttcaattcccatctatgagtgagaacatgcagtgtttggtttttttgtccttgtgatagtttgctgagaatgatggtttccagcttcatccatgtccctgcaaaggacatgaattcatcattttttatggctgcatagtattccatggtgtatatgtgccacattttcttaatccagtctatcattgatggacatttgggttgattccaagtctttgctattgtgaatagtgccacaataaacatacgtgtgcatgtgtctttatagcagcatgatttataatcctttgggtatatacccagtaatgggattgctgggtcaaatggtatttctagttcaagatccctgaggaattgccacactgacttccacaatggttgaactagtttacagtctcaccaacagtgtaaaagtgttcctatttctccacatcctctccagcacctgttgtttcctgactttttaatgatcgccattctaactgaactacaaaccactgctcaatgaaataaaagaggatacaaacaaatggaagaacattccatgctcatgggtaggaagaatcaatgtcgtgaaaatggccatacaaggtaatatatagattcaatgccatccccatcaagctaccaatgactttcttcacagaattggaaaaaactactttaaagttcatatggaatcgaaaaagagcccacattgccaagtcaatcctaaaccaaaagaacaaagctggaggcatcatgctacctgacttcaaactatactacaaggctacagtaaccaaaacagcatggtactggtaccaaaacagagatatagaccaatggaacagaacagagcccccagaaataatgctgcatatctacaaccatctgatctttgacaaacctgacaaaaacaagaaatggcgaaaggattccctatttagtaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgtgcaaggacttcatgtctaaaacaccaaaagcaatggcaacaaaagccaaaattgacaaatgggatctaatcaaactaaagagcctctgcacagcaaaagaaactaccatcagagtgaacaggcaacctacagaatgggagaaaattttttcaatctactcatctgacaaagggctaatatccagaatctacaatgaactcaaacaaatctacaagaaaaaaacaaacagcgccatcaacaagtgggcgaaggatatgaacagacacttctcaaaagaagacatttatgtagccaaaagacacatgaaaaaatactcatcatcactggccatcagagaaatgcaaatcataaccataatgagataccatttttttttttttaatggaaagaacctcctgtaaaatgaaggccttgatgactgggagggagcaggcagggaattaggtgatctacttgttgcagtattctggaggattgttggattatgccttctctctctgttccagcggcagaaggtttcctttttaaccttcttacctttgttttctaccctaaccccaagggggattctttgcttggtaggaaaatgtaatgtatgagcagggtggtgcaggaaaaggctgggctatatttcacactagttcatttaagctgaaactatgcaaaacacagacttatgccagcaagcatttttctgtggaaaatctagttgttttttcacctcctagaatggctcatgtttcagaggaagtgtgaccaagttcacatgcaacatggattatctgccttaatatttgagatcagttttttgtaatttggaaaaattttaaactacagaaaaaaaaatctgagtcacaaaaaagttgagagaagaatatggtgagcacacaatctatacccttcacctagattgactttttattaaaatttttaccatctttgtgctgtctttgtacacacacattttctacacacaaacacgtacacacataatttctttttatggttggaacacttaagtgtaaattgtacacatcacaatatttcagcatttatcttctgagactaagaacattctcctacataaccccccatgctattattgcacttaggagaattaatgatcatgtcaagtatcagctaatgtctattccatatttaaatatactagaactttcaagtatatttgcagatctggtgtgttcacctcccttcccaacctcaaatggctctttgcctattcttgtttctttctttttttgttttttgattgaagattatactgcagttagttatgtctcttttactctaaaacagaacagaaatattatattgtttttcgtgatattgacttttgaaatccaggcgagttatttggttgaaggtcctgcattctggacttgtctgattgtttcctcattgtctgattcaattcaggataaattctggggtataggttaggagctattctatactacccattgtatctcctcaggagggatcgtgtccaggtgttggtgatgctgtttgataagttggtgaagctggcatccacctgatatttccattgtaaaggctacattttgttgttatatgagtagataatttgtgggatgatatgtcaagatcacatggatattttctccagcaacctttcacctgatggttttagcatccatgatgattctttgctgaaccggttattctattgatgtttaaaaggtggcgatttttctaatcctataatttctcctgtatatattgtccaacattccttggtaaacagaaactttctttcctcttcccccttttctttgtcttttaatcttttttatcaacataaattactggatttgcatactttaattctgtattatactccattaccagtatgcccttacaggcaaagcgtctcataactggtcagtgggagggctgggcctcaagctggcttctcattctcagctttcaggtgctccttgcttttggcaaattagttgttccaggctcaccttggaccgttcctgcctttgacctggaaatcacttttccccccaacaagaagctctgattccttttatttaggaatggtgcttaggaacaaagctctgggcactggcttattgttaccagggtgttactgcttctctgacttttcagtgaaaagagctgggaaatatataaactttaaaaaattgaaagttcataataacatctccttttaaatttaacattacaggatttttctttgttttttaaattttgtgtctctctctgcgaaaattttggttgctacatacattaatatgtttatgggcctttatttgatagaattggaagacctctgaaggtataagaaagagcaaaaatgtttaaaaaataaatgaataaataggctgagcgtggtggcttacgcctgtaatcccagcactttgggatgccgaggcaggcggatcacctgagatcaggagttcgagaccagcctggccaacatggtgaaaccccatctctactaaaaatacaaaaaaattagccaggcatggtggccgtaacctgtaatcctagctactcgggaggctgaggcaagagaatcgcttgaacccaggagctggaggctgcagtgagccaagatcacaccattgcactccagcttgggtgacagagcaagactctgtctcaaaaataaaataaaataaaataaataaaataaaataataaaataaattggaataccttctgatgtgctttgtgttctattttatcccccttcccattaatagacatgctttttctttttttaaacatataatatccaaaaatacagccttacatttatcagataacaatgtgtaatatatattttacatatatagtataacataatgtgtgtattttctcaaaagcttgtgacagatttgaaaggccgactttgttttcttggttttatcgatgagataactgaagctcttggtatttaagcagtttgtagctaaaaggtgctcaggcctgtcaggttttaaattccttggccttttcagtgttctgagctgcctcttctcataatctcacagtcctcttttgacattttcttttagattttgtattatcttaaatctcagtgttttactgtgacacagaaaatgttagatggccttaatcctttgccctataacaaaccttttagttgcaaaaactgtgaacatctcagttatttttttcctttcatttctagttggcgtgtagtaattgtacatattagatacagagtgttagttcagtacatgtatataatgtgtaataatcaaatgagggttttatatcaatttgttgactaaatttagttaagtgtactaagaagcatttttacgaaagcccgggaatagaagctgtattttgaattctgttactcaccttaacaggctgaataatggccacccaaagagatctattcctaatccctggaatttgtaaatgttaccttatttggaaaaagggtctttgcagatgtcattaaatcaagaattttgagatgaagatattactctggattgtttaggtgggctctaaattccatcacaaatgtcattagaagatagaggcaaagggagagttgacacagaaacagggaagaggaagagacggggtgaccacagaagtagaggttggagcgttgcagccataaaccgaggaatgcctggagtcaccagatgctggaagaggcaagaggggattttccgcaagagcctttggagagtctgtggccgtactgaactcttgatttagggcttctcatccctagaactgtgatagcataaattttgttgtgttattatgggaatttgttttgtttatttatttatacttatattttattttatttttagacaaagggtcttgctctgttgcccaggctgatctcaaattcctaggctcaggctatcctcctgctttagcttctggagtagcagggattacaggcatgtgccactgaaatcaggtatttatatttctcttttttttttttttggagatggagtcttgctctgttgcccaggctggggtgcagtggcacgatctcagatcattgcaacctctgcctcctagttcaagtgattctcctgcctcagcctcctgagtagctgggattacaggggtccgccaccgtgccctactaatttttgtatttttagtagagacagtgttttaccatgttggccaggctggtctcgaacttctgatctcaagcagcccacctgccttggcctcccaaagtgctgggattataggtgtgagccaccgcactcagccccagctatttatattttctaattgacaaaagttgaatatatttatgatatgcaacatgatgttttgaaatatgtatacattgtagaatggctaaagcaagctaattagcatgtccattacctgatatacttatttctttttgtattgagaacacttaaaatctactcttagcaattttcaagtatacaatatatgattattaagtatagtcaatatgttgtacaataggtctcttgagcttactcctctaactaaaattttatattgttggaccaacatcactccagggcctttccccatactgtccccttcccccaagggaggccctggcaaccaccagtctgctctctgtttctatgagtttgacttttttagattccatgtgtaagtgagatcatgtagtatttgtctttctgtgcctggcttatttcacttaacatattgtccttcaggttcatccatattgtcacaagtgagaggattgcctttttaaaggcttaatagtattccattgtgtgcatgtatcacattttcttcatccgttcatctgtaatgggcacttgagttgattgcatatcttggctatggtgaataatgctgcagtgaacctgtaagtgcagatgcctcttcagtgtaccagttttattttcctgttgtaatttgtcacagcagccccaggaaatgaatacactcatgtagctgttttttccgggacgttagaaagcttatagttgtgaagaattttctttgccaagggccagcctgatccggaaaaaaacctttttctagtggtagttttggcttgatccagacattttccagtcagtgacccctgttgtcaactgtctctgtgagggcatggctgcttcctaaagacttcacctatgtgtgggctgggatggaactctgggcagggaatttaaatgcctgtgcacttacggccttaacacctccagcttgctgagagagggatcctgttttctgtagcactcttgtttctagtggaatgatgcatgagtgccttgggtacattggtcagccttccatgttggagcttctctctgaacactctccagttattcagcagctctttgggaacctcatctctgtgcttggcacagttgtgtatattgaggataacatggtgaatggaaaaaaaaacacagtgcttgttgccctcttggagcttctaatttaatggagcagacaggtattcatcagggagcctgaaataaatgtgaattgatgtagtgatactgctatgaaagagagagatggtgtgagtaacaccaaataagggcttcatttggactgggaaattgggaagactttccatgagtgacatctgagttgcaggagttggaggtgggagtacagaggacagagagttgcaggcagagggaacagcagttgtaaaggtcctgtgttttgaaatgcagaggctggcttgcctggagcatggaagtgcagggcatggtggtgggagaggtgggctgtgcccagactgtgtagggacttgtacctcatattaaggattggggttctttatcttgagagtgctggagagccatcaaaggctaatttgaatgaggggattggcacgatttgcctgtgtaacagcatacttgctgttaatactctttgttgtgtttagacctccctgcattccactgttttaatctacttaatgatggatttaatcaatttatgaagttccgtaagggagatgagaggagactttgagtgtctagggctggaagccttttgtttttggtgggccttaatgaatgaagagggcttgtcccagcatttgaggaggaggtgggactctaaggacttctcagggcctagaccttactgtaccacgtaactgaactgtaccttttagatttggttgtgattattattttttcattcaaaatgagaataaagctttgtatatcttctaagtataatttttatacattgttcatacaacttacctgttaagagcaaggtgaaaattcttcctttgatctttgcacacgttctatttgttgttgttactgactgttatctcgttaaagggagtcaaggctaaagaactgtcttcacttgtgactgaccttctcacctgggaagaccacatgggactagaataagctggaggtgttgagtgcctgacttactgagggttacgggtaccaagcactgtctgtgaggtgggcaccgggtggctcagggatccagttggcttgctagggtcacaaaggaatttaccacacatatgtctttcatctccagtgtggaacctctttgcactccatgtgcaaacagaagttggcacttcttttggaaaagggaatgttagatatctcagtttgctagtgatgaagctgacagattcaccataccgccttgtcagccccctgccactttgttgtaccaaaatgacagcaatataatcaaacccttaatttttttttttttttttgagacagagtctcaggctggagcacagtgggatgatctcagctcactgcaacctcccttactgggctcaagcaattctcctgcttcagcctccccagtagctgcgattataggcatgcaccaccacacccggctaatttttgtatttttagtaaagacggggtctccccatgttggtcaggcttgtctggaattcctgacctcaagtgatccacctgcctcagccctcccaaagtgctggaattacagacgtgagccactatgcccggcctcagataattcctttctgttcagagtaaagagattgagtcctgggacagttcctgttttgatgcatgaagaataaaggcatcaaagaagaaaagatgaaaaagaaatctaaagtttagaaatatgtggcctatataaataaagcatgttctctgcctttcctatgtttgctattctttttctgaggaaagaatatatggccttttaaagatttcacaaggtgaaggaggatataataatgttgatgataaaatcatttttatatacctgttttcattttgtgaggctgtcgtgatgaaatccaggccttggccacatgctgggagttaatgaggtttacaattggcaatacttaaagaatattagggtaatatatttaaacatcagcagttcacagcctgaagtgctcatcatctgtcaagttataatacagaatcaataaggggaggtctttcaatttgctaatgaggaaagttttctatactattagggtagacatagatttcagataaacatctaaaattcataaactatagaatttggcgaaagcatctcttcgattaaaaagaaaccttgataataatcaatagcagtcacctgagaagcttagattttcttcttagtcatcagactcccaaattaatctaccaaaacaaaaagcctcattaacagctctcattgaatcagtgttattttttcctttctctcaaggtgtctgattaaccccctttctttttgcattactcactttgtgttaatatttgatgtctgaaatcatggggcaggggaggggttgtgcaatgtggtggctagacactgtctacaagcagtaaattaaaaagaatttttaaaaaggtttgtattatgttgctgatgtattagaaaatctctaggaatgtcaggtgcctgggttttctttttctttttaatttcagaaagggttgattgctgattgggtgctgattttgcttctcattcatatgtacagatagcgctcctcctcctcttacccagctcctcttgcttaccaatccaagccttcttttggagagttttattgaaaaggaaaggtgagaaataaggccataactggagggaaaagggaggttgaaggagggtcttttctaggtgaatgccaatgggaaagactcacttgagagtagataagattgacaatgtaggagagaaaggaaagacattctggagcattgtctaggaggttggcctcttgtaagagcatggagagttcatccagaacacctgacctcaaagtgtagccagtggactcctggaagtccctgagaacttttcagaagtccaggaggtcaaaactatttgcacagtagtaaaagcatgatctacctttttcaccatgttgatatttgagctgaggtttctaaaagcaatagtgcgtaaaacttctggtgtcttaacagcaaataaggttttgtctgaacattgatgtccctccaaaattcatgttgaaacctaacctgcatggtgatagtgtgaagaggtagaactttggggaggtgattaggtcatgagggctctgctctcacagataggattagtacctttgtgaaggaggcttgagggaatctgtttgccccttctgccatgtgaggatggagcaagaaggcaccatctatgaaggagaaagcttttaccagacaccagacctgctgctgccttgatcttggacttcccaactcctagaactgtgagcagtaaattctgttacttataaattaccaagtactaggatattttgttataataacctgaacagaataagacagacaccaatccaaacagagtaagcaatcattattttcttcattacacattcatcatcttcgtcatactgattctgcttcagaatgtccttgaagaagcagtcaaaatcattgattttattaaatcttgctcttgattacacaagattacattttaaaattctgagtaattaaatggcaagtatgcataaagaactctttaatgtagtatggtggttgtctgaggaaaagtacttgagcagttgttttgaattgctagttgagctagtcttctactagaggatacgggataccattcttatttgaaagaatgacttttttgaaagatttaaaattttcatgtttcatcttcctaatacttaaagactttctgatgtcattggtggtgatgttaatgaatgtggcttttaaatatagtttaatgaagtttcctaacatttggatgatctgcataatatagagaaacagtattttcccagttgaccggtgtgcatggtgttacaaaattatgcatgggtaacagatagtttgaaaagtgctcatagacccatgaattttaaggtaacagagaggagaaaagttcactgatacagtttcagattgcacattgccactagtctttaagaaactttacttgttgggatttggtgttgtatcaaagaagaacatccccagttatctaaaaaggccattaaaatacttctttcttttctaactatgaatctgtgtgaggctgaaatcctttcatattcttcaaccaaaacaacatattacagcagattgaatgcagctgttttccattaaagtcagacatttaagagatttgtaaagatataaaactgcttttctcactaaattttctgttttagaaaatatagttctttggctgggtgtgctggctcatgcctgtaatcccagcactttgggaggctgaggcgggaggatcgcttgaggccaggagtttgagaccagcctggctaacatagcgagaccctgtctctacaattaaaaaaaaaaaggtatagttctttttcatacaaatatatttatattaccatgtaatagagttactttttaatgaaataaatattttctaaatttcccaattttaatttctagtatggtaaatatgatagctataatccacataaataaaagctctgtggggacctcaacaatttataactgtgttaagaggtcctgagacctaaaatttttgagaaatgctgagctagaagagaagatagagactagagtagagagagagtgtagatgtagtggtgagatttggggacaggttgtcttttggtttctttgatttttttccaggaaatagatgagatggaggtgcaggttgaggtattggcagtttgtggagagagattcgtatactacatagttatctagaagtgggagggtgaatgtgtgaggaacagcatgatggctgggcaggacccacttgagtgcttacctgaggattagtggtcatgaaatttaaagtgagaccagttagtgtggctgtatgtttttcagataaggccagtcgttcaggcccaggtagtaagggttggatgtagctagggttgaggtcatggccactgaataatccagagtaggtgaggttccagggaggtaggtgcaggggcgtgcaagggagtaattatgatgatagactatagatttagtctgggcaaggagcaaagagaggacattgggtaggacgcaatgagggatggtgagaaggtgacatgcttaatgaattgtgagtttcagcatggttgaaggttgttgatcaattgggatgtgtttatgagggactgaacaggaagactagaatatagtggccataaagtgagatgcatgaaattgagaaaaaggagtttttggtaatggcaagtaaagtctagagtgtgaccatgggagtgagtggctgaggaaggatgaaagaaaggccatcggaggagatgagttaatgtaattggaggccttagtgtttgaaggatcagtatattgaaggataagtatgttgaaaatattgagaactaagatagaagttgagagagtgtcatcgagccaagagctaaaatacggggtgagaggggaatccagggttattagatcacagaaacaagaggtatgctgagtggtatagtcagatgatgggaatatttgaatgggtgggggttaggaaggagaatatgggatctacccaacctgcttataggcctggtgcaacctaggactgcaagaggaaagctcatccctacacgtaagaggggtctacagtggaagcattgtcctcaagggacagccaggtattggttagagcaagaaagtgaagagatattttatggaaggattgaggaggagattttggtcactatacactgaattctagagaacacagttggagggtttctgggagatggtgacagaataggcaaagtccagggcctctcagggattagacgtgagtggtaaagggtaacctgggtgtccgggactgttggtcaaggctgacattcacggaataaagagaagaatgcagttagtcctggtagactccagattgtgcctgctggttgatagggatctttgcagagaggcaaggaagcttggagaggggcaacttttattacttaaagaacttttaaaataaaaatattttgtgagcagtagctctgctgtttttttttttttttttttcctagatggttggaccaaaggatgaaggaaatgaatagttactgagcatatatagggttccatatctggtgctaacaatttccacctgttttcttatttaatcttcatacaagaccttaaaataaatattttcactgcccatattataaagggaggtggagaattagagaggttaaataatttgctcaaagtcatatagctaatgagtggtggaactagcatttcgacccagttctttctggcttgtgctcaatctgctctaccatgaaactttctatgcatagagaagaatatttaaaattgagctttgcacgagaactttgcttatgtctttgcttagaagttctgatggcctttgcaagattctttgcccttgagactagtcatttagccctcatatttggccaacataaggtgaatataaaacctccatgagaggctcttcgtcacccatacccacacttatgaaaaactggccttgcttacctcttactctttttttttaaactgaggagtagtttttggaacacttttccctttttactgttcttatattgaaccttgagttaccattgcgtatcatattctcagaataagaataagtatcgttactgggccaacttaataccaacagttcttccatattcttcccagcatatgatgctgcttagtgaatgcctgaaagagcaaatactgttctttcctctttctttgtttggtgttagtgtagaaagataagctggattaattgtttgatttgcttgatctagactgtaggtgtttaaaacataaatctaaaattttaaaggaaaggaaatcaaatgtaagctctgtttcctagctacttgagaatctgcttctttaccactgtcagaattagaggtacaggatgtggagttgcttaaattaaaacagtcttgtactgagctatgaggaattcatgaagcaaaactgctatagtttgaatgtgtcctgaaagttcatgtgttggaaacttagtctattgcaacggtgttgggaagtggggacctttaagagatgaacatattaatgcttttatcgcaggcatgtggtatgtgggagtgggttctttatctcaggagtgggtttcttatcaaaggatgagttggtcctcttccccgtctctttcccttgcccatgtgatgccttccatcatgggacaacccagcaagaaagccctcaatgtcagtgccttgatcttggacttccaaatcccacaacagtgaggaagtaaatttttaaaatgaattactcagtctcaggtaattctgttctagaagcataaaatggactaagacaaaaatgttaggagatatagtacccaactttcccattgattgtggcataattgtgccatgattgtcagtgagttgcttcctagtaaatacagtgagattcagagattttaatgaaggtttttgagagtaaagtaagacttctcttgcaatctgatgtaaaggttttgagatcttcagtctggaataagcaaaaggtgaaagaagataactgatgaaagaacttaattgtcagaaattttagagtaacttagtctgaaataaatgatatatggtaaggtaaaatggccttctgctacaaatctgagacaaccttgatacttgaaaaatatagattaatttcagatttggtaactcatttaacaaatatatattgacaccaactatgtgccaggcactgttctaaacagtgtgcttttatatagcaaacagataatgtaaacaaaagatatatatagatgatatagaggtaggttgttatatttattaaagtgctatggtcgataaagtggtcagggaagatctctctgaaaagtgacatttgggcaaagacttgaatgaaggagtaagccatgggagaccctagggattgagccttctcaatagagaagaatagaggggataacaggtgcaaagagcctgagaggggagggtgcttggcatgtttgagaagcagcaaagagaccagctagtagagagggttgataggagagtgaaagaagtataaaatgtatcccagggccaggttatgtagatgttgtagaattgtattttgagagtagtagaagtcattggagggttttgagcatgggaatagcatgatctgcattacattttgaaaggttttgcctggctgatttgagagaatgggatgaagtgggtgacagtggaagaaagggaaattaggactgtgctgcagtaatctgtgtaaaaggtgatggcaagactagagttgaatggtaagaagtggttggatttgggattttattgatggattagatatgaaatatggggaatggcgatataagcaaatgagatagggaatgttgggggaagagtaggtttggaagcaaaattaagagttctttaggacattagaatattgacctccctgttaaacatgcaattagagaggcaggctgtgagatgtatgcttagagatgagagtcaatgtaattacttatttggtctgagccaattctcagcataaggagttggtgctgttgtaacttcagtgagttgtgttttgtagggtgggggaattggggtcttttttgtattgattattatgaacttacaggtttttatatgtttgtgttttaattgcaatatctcatctttggccagtaggaacccttttatattatctcttttgtcctttttgatatgatccattgatttttggtagcttccttgtttctggcaaaataggttgttattttatatatttcctgccctgaacctggaatcagttgctctgcttgaatctcccccttttttaattattattatattttaagttctgggatacatgtgcagaacgtgcaggtttattacataggtatacatgtgccatggtggtttgctgcacccatcaacccagcatctacattaggtatttctcctaatgctatccctccccttgctccccaccccccgacaggccccagtgtgtgatgtttccctccttgtgcgcatatgttctcattgttcgactaccacttatgagtgcgaacatgcggtgtttggtttgctgttcctatgttagtttgctgagaatggtggtttccatcttcatccatgtccctgcaaaggacatgaactcattctttcttgtggctgcatagtattctatggtgtatatatgccacattttctttatccagtctgtcattgacgagcatttaggttggttccaagtctgctattgtgaatagtactgccataaacatacgtgtgcatgtgtttttatagcagaatgatttgtaatcctttgggtatatacccagtaatgagattgctaggtcaaatggtatttctagttctagattcttgaggaatcaccacactgacttccacaatggttgaagtgatttacactcccaccagcaatgtaaaagcgttcctatttctccacatcctctccagcatctgttgtttcctgacttttaataatctccattctaactggcgtgagatggtatctcactgtggtgttgatttccatttctctaatgaccagtgatgatgagctttttttcatatgtttgttggatgataaatgtctttttttcagaagtgtctgttcatatctttacccactttttgatggggttgtttttatcttgtaaatatatttaagttccttgtagattctggatgttagtcctttgtcagatggataaattgcaaaatttttctcccattctgtaggttgcctgttcactctgatgatagtttctttcgctgtgcagaagctctttagtttaattagatcccatttgtcaattttggcttttgttgccattgcttttggtattttaatcatgaagtctttgcatatgcctatgtctgaatggtattgcctaggttttcttctagggtttttatggttttatatcttacatttaaatctttaccatcctgagttaatttttgtatacagtgtaaggaagggatccagtttcagttttctgcatatggttagccagttttcccaacaccatttattaaatagagaatcctttccccgtttcttgtttttgtcaggtttgtcaaagatcagatggttgtagatgtgtggtgttatttctgaggcttctattctgtcccattggtctatatatctgttttggtactagtaccatgctgttttggttactgcagccttatagtgtagtttgaagtcaggtagcatgatgcctccagctttgttcttgttgcttaggattgtgttggctatacgggctcttttttgtttccatgtgaaatttaaagtagttttttctaattctgtgaaggaagtcaatggtagtttgatgggaatagcattgaatctataaattactttggtcagtgtggccattttcacgatattgattcttcctatccatgggcatggaatgtttttccatttgtttgtgtcctctcttattttcttgagcagcggtttgtagttctccttgaagaggtccttcacatcccttgtaagttgtattcctaggtattttattctttttgtagcaattgtgaatgggagtttgctcatgatctggctctctgtcttttattggtgtataggcatgtttgtgatttttgcacaagaattttgtatcctgagacattgctgaagttgcttatcagcttaaggaggttttgggctgagacgatggggttttctaaatatgcaatcatgtcatgtgcaaacagagatcatttgacttcctctcttccatttaaataccctttatttctttctcttgcctgattgccctggccagaacttccaatactattttgaataggagtggtgagagagggcatccttgtcttgtgctggttttcaaagggaatgcttccagtttttgcccatttagtatgatattggctgtccgtttgtcgtaaatagctcttattctttttgagatacgttccatgaatacctggtttattgagtgtttttaccatgaagggatgttgaattttatcaaaggccttttctgcatctattgagctaatcatgtggtttttgtcattggttctgtttatgtgatgaattacgtttattgattatcacgtatgttgaaccagccttgcatcccagggatgaagccgacttgattatagtagataagctttttaatgtgcagctggatttggtttgccagtattttattgaggattttcatataaatgttcatcagggatattggcctgcaattttctttttttgttgtgtctctgccagattttggtattaggatgatgctagcctcataaaatgagttagggaggagtccctctttttctattgtttggaatagtttcagaaggaatggtaccagctcctctttgtacctctggtagaatttggctgtgaatccatctggtcctggactttttttggttagtaggctattaattactgcctcaatttcagaacttgttattgatctattcagggattcaacttcttcctaatttagtcttgggaggatgtatgtgtccaggaatttatccatttcttctagattttctagtttatttgtgtggaagtgtttataatattctctgatggtagtttgtatttctgtgggatcagtggtgatctcccctttttcattttttattgcatctatttgattcttctctcttttcttctttattagtctggctagtggtctatctatttggttaatcttttcaaaaaaccagctcctggattcattgattttttttgaagggtattttgtgtctgtgtctccttcagttctgctctgatcttagttatttcttgtcttctgctagctttcgaatgtgtttgctcttgcttctctagttcttttaattgtgatggagtgtcaattttagatctttcccgccttttcctatgggcatttagtgctataaatttccctctaaacactgctttagctgtgccccagagattctggtacgttgtgtctttgttctcatttgtttcaaagaacttatttatttctgccttaattttgttatttacccagtagtcattcaggagcaggttgttcagtttccatgtagttgtgtggttttgagtgaatttcttgatcctgagttctactttgattgcactgtggtctgagagactgttttgatttccattcttttacatttgctgaggagtgttttacttccaattatgtggtcgattttagaataagtgctatgtggtgctgagaagaaggtatattcttttgatttggggtggagagttctatagctgtctattagttctgcttggtacagagctgacttcaagttctgaatatccttgttaattttctgtctctttgatctgtctaatatggacagtggggtgttaaagtctcccactattattgtgtgggagtctgagtctctttgtaggtctctaagaacttgctttatgaatctgggtactcctgtatgggctccatatgtatttaggatagctagctcttcttgtcggattgatccctttatcattatataatgcccttctttgtctttttggatctctgttggtttaaagtctgttttatcagagactaggattgcaccccctgccttttttttgctttccatttgcttggcaaatattcctccatccctttattttgagcctgtgtgtctttgcatgtgagatgggtcacctgaatatagcacaccgacgggtcttgactctttatcccatttgccagtctgtgcctttgaattggggcatttagcccgtttaaggttaatattgttatgtgtgaatttgatcctgtcattatgatgcttgccatttattttgcccattagttgatgcagtttcttcatagtgtcgatggtttttacattttggtttgtttttgcagtggctagtaccagtttttcctttctatatttagtgcttccttcaggagttcttgtaaggccggcctggtggtgacgatatccctcagaatttgcttgtctgtaaagtattttatttctccttcacttatgaagcttagtttggctggatatgaaattctgggttgaaaattattttctttaagaatgttgaatattggcccctactctcttctggcttttaaggtttctgcagagagattcactgttagtctgatgggcttccctttgtgggtaatccgacctttctttctggagcccttctttttagtaggcagttgtatttatagaccacaatctggggattaggtatgtttccttcttttgagttgtcactactttgagaccttttgtttttctcttctctttatttattattattattttgagttagggttttgccctgttgtccaggctgaagtgtagtggtacaatcatggctcaatgcagcctcaaccgcctgggctcaagtggtcctcctgcctcagcctccggagttgctgggaccacaagcacacaccaccatggctggctaaatttttaaattttttgtaaagatggggtttccctgtgtttcccaggctggtcttaaacttctgggctcaaatgatcccgccacattggcctcccaaagtgctggaactacaagtgtgagctaccgcacctagctgatgccttttcaattcattagagaaaaaattttccattcatgctgatatttcaaatgtaaagataaattgacacagttaaatccaaagtaattttattgttttgatttttctatctccgctctttcattgaaaatcctggttaccagcaacattcacagtattacatatttgccatgtgtaggatatatccaaaatagtaacacctttattgctgccaacaattagatactgaatgaagtttaagatttctttttagttctgttgtacttagactgtgttccacaaagtatatatagttaaaatactgtattctaaagttattggaaagaattcatttaattctgtgtggttttgccaccaacttaatatatatatagggaggttcattttttcagtttattttcaatttttagggattgtcttttttattttcaacttaatttaatttttgagtatgtaaaacatatgtttcccaaatcaaaactatacaacagaaggaaggtatgctcagggaagtctgtcttaacatgcccgtccttttcaccctgactcttccttcctttttataggtcattcttttttgtattagttttttggtttctcctcccacagggtattttttccccaaatataagtaaatttatatgtgtatttgtgttcatctttccttccccattcgtatccaaaaggcagctctatcaactctatatactatatatacgctcctttgagggagtgtgtatgtgtgtgtatatatgtagtatatgtgcatgtgtactagggtttgctcatgaaacagatccaatagggtatatatacacacacatatgtgggtatatatgtatatttatataaagagagacaaatacacatgtaaatgtacatgtaaataataaatgaagacatttattataaggacttgtctcacatgactgtggaggctgagaattcccagtatcagctgtctgcaagctggagatctgggaaagccaatggtgtaattcagtttgagtctaaagacctgagaaccagggagccaatggtgtacttcccagtctgagagcaggagtagatccatgttccagctctaacactcaggtggagaaagcaagttatccctttctccacctttttggtttattcaggacctcagtggattggatgttgcctaccacattgggagggcaatctgctttacccagactgcctatttacatgcaaatctcatccagaaacacccatacagacacactcagaaataatgtttaatctgactaccacatgttgctatcgaggtaacacataaaattaaccatcacagcatttgtataatgtttgtctccagggaagacagacagacagacagacatgcgcacacacacatacagcacacacacacagttgcttttatctcttagtcgtgtgttttgaagataattctataaatatgtaaagaaatcttcctcattcctttttatggctgcatagtgtaagcatatacatttataattatttttccagtttattccaatatctgttaaagtttacagaccagtgcttttaaggtttacattatttggctcatcaggatcttttcccaaaccattttagggctgttgtcaaagagcaatggacaaaccctaatgatgagatgaactttactctcagaataccgtctcacttgctcctatgttctgcattccctgcaccaaacacttcctatgctgtctgcttccctgtccactcatacaggaaagggcttcgatgttatagagtcactcttattgctcctgctaactgctgtcctgataacaatgggtcttttgcatgggaaaagcattatagagtgaaaggatcactgatagcagtcaaaaaaacacattttactatgtcttttaaaatctgtgggatcttagacaagtgacctatcccatgtgagcctgttttctcatctgattaaatggggttgttacttgctcggtgaatgcttgtgttgtcacccagtgaaataaactccagggaagtttagttagctttcccttctcaatttacctgcagatactgtttcaacattcctctctcctctcattccttccctctcttattcctttcctcacctcctacttttcttccccaattcctggcatctttcctggtggcaaacagaccttccatgtgaagaaaaactcctcataattgcactttcctcttcagattctgccccatttctcttctttctgcaacactcatcaaaagcactgtctgttctggcccttacaattaattcctctgcccattgattcttttttgagatggagccttgctctgttagccaggctggagtgcagtggcatgatctcagctcactgcaacctccgcctcccgggttcaagcgattcttctgcctcagcctcctgggtagctggaataacaggagcatggcaccatgcccagataatttttgtatttttagtagagacagggtttcaccatgttgtccaggctggtctcaaactcctagcctcaagtgatccacccacctctgcctcccaaagtgctgggattacaggtgtgacccaccgtgcccagcctgcccattcattcttgaatccactctccccaagtttcctctgctgctctactatgctctaatctgcccttgttacgatcttcaaagcagaatccaatgataatattagttctcaggttaacacacttgcctcttacccctttttgcaatactcacttcacgttcattataccatgttcccttgcatccctcagacctcactggttctcacatctctagtttttcctaactactttttgggtgatcttgtcccatctcatggtgctaaatacttcataacttctacttttatgtcttcagccctctcctccctgctgcttctgtgagagtccatttgcgtacctaataggcccctcaaatgtcacatgtcctgacctaggctcctgagccttctctctccaagcattctttcctattgcttgctcagtagattctgtcttgcagttgctcaggccccaaactctagggacatccttgcttccttcttttctttcacacctcccttcaaatcttacatccagtctagttggcctcactatcagtatatgtatcgtcagtactccctctgcccaatttcttggaaaggtgacagtagcagcaactgctgttcaggcttcatgataccagcaaggataatacaaaaaaaggaagatgctggaaagttgaccaagaaagagacccagtaaataagtctggactcaagtccccaaataaaaaaagattcaaaggcaaactctaagacaagctctgtttttggtcttgtttcataaagtcatatagaaaaaaaatataaagacgtttccaactgtagttcataactgctgtattcatctgtgaaggattgatgacttgaggctctctgaccagggtgtccaataagaagtgcttagtaaagactcatcaggttggtttccaacacacagcccacattcagtctatacccaaaatagcaaagatggtgctacaccaactgctagtgaagatgcttcaaatgggcagtaagatagtaaatgtacacacccctgcaggtctgcttcacttttattttctttccaagtacagtttcaagaacagtttattaagtaaagcaaaaaaatagaaaagaaaatagtacgactcaatcagttcactccatatcaatgcaaattcagatgcaatgcaactggtgattggtgtgtggcttccagttggccagttctgtagaatcattcccactgagtgattcaacacccaatgatgtgaccctgcattttacttgatttactttttaaaaattctgctcagcattatggaggatgttactccataaccagacgcaggcatgaccatctctcacctggattattgtaataacttctcaccaaatcttcttgtgcagccagagtgattctgttaaaatctgagttggattatgtcactctctggctcacaatcctttatggctctccattttcactcagagtaaaagccaaagcccttctcgtggccaacaaggccttgtggtactctctccttacgttacctccccagcccctcacttcatctgctgctctttcccttaattactttgttctggtgacattggtcttcttgccgcaccttgaacacaccgtgcttgccgtgcttggtcccacctagaggccttgtacttcctcttccttctgtaaggcacttcccctaagaatctcactcacttcctttagggctttctcatggtggttatcttgtataatacatgtgggtttcattaattttttttttgtctcctcctctttcccacacacttgactgtaagctccacgaaagcagggatttttgtctgtttagttcactgctgagtcagcagatcctagaacgtggctggcacatagtagcactccataagtatttgtctaatttgaatggattgaacacataatgttccatgcacatgtgaggtattatccagaagaggtgggattcttagatttctctctatggttccttctttgaatttttacatgttaaaatctctgctgtcatttttctcccaggaccactgtaatattttatggagcctctttttttttttttgtaacaggtctaaaacttttagcaaatcttttttcttctcctgtcttcacttttctcctccccaagtagactgcttccacagtattttggggttgttctagtttttgtaaactttttctgaggaattctttgtgttgaaaaaaccacctatatataggattagattctcatatttttgagaatcctgccccattcttcagcatccttacaagggactggactcatgtcccaaagtgttggtggattccaaccattcggcatgtcctcgctcatttatgtcttatggtctggtaagttaactgccttctgccgtagagttaagtaaagacagccatgtcgctgctcttttagtgaattttggctgttcacattattcttcaagttatttagaatataactttttagattcactgaggatattgcatctacttgggcaaaaccctgaaagcccctaaggatttagctgaacatgtaattcatattgaaacccaccttctcttgccttatgattttctgattcagtactttcttctagagttttttttctttttttgagacagagtctcactttatcacccaggctggagtgcagtggtgtgatctcagctcactgcaacctccgcctcctgggttcaaacaattctcctgcctcactcagcctcctgattagctgggatcacaggcgtgtgtcaccacacctggctaatttttatatttttggtagagatggggttcaccatgttggctaggttagtctcgaactcctgatctcagatgatccgcccgccttagcctcccaaggtgctgggattacaggcgtgagccaccatgcctggcctagagtttttttttttttttttgctaagttaagaaataaaacagtaaccaatttctgaaggaaaaagcattaaaatattgatgttgcttttctgcaatacttataccaagaaaatgcaagagagtctcaaaagttgtgtagcttaatttcctcttgcaaaaatataaagtactcccaacagtttctaattttgatgatcttttacaattactgttctgtgttgtaatggcctgcgttttaaaaaagcttgaaattgttaggagacctttagacatagaacttggtaagaagtgcagagataggatggcatagaatggggaaacatgccagatcaattgggacagaaaatttttcttaactgcttttcagcatttatataggttcttccatgagcaaaataaaatatgaacctaaatagaatgggctcaaacagtcataataaactcctttggttattttcagaaaatctatattcacaggtggcctgtgttaataggtgaattcattgtattttggtgtggctatttgtataacaaaacatgactaaatatgaaagatgtgtatgtctttttctttaccagatcttgcgccagtttttaagcaagcaaattatgttcatgtagtaaaattttaatctgtattgggaatagaggtgggaatagtagtattctgtttactgtggatttggagtaaaatctagaaatgctacttaatcagcatattgtaagcagaaattactttttgtcttttttacaaaaaatggacatgagagctcactccgttgcccaggctggtctcaaactcctgggctcaagcgaccctcccacgttagccttccgagcagctgagaacagaggcacgtgcaattgtgcccagctttagaaatcactttttattttaattcttatttgtaacatttcataaggtattaggctacttttcccagtcactaccgtttatacaatttagttttaatttcttaaaattttatttgaaattgtagaatgtcttaatcattcagaatgtgaattgtcatggaggtgtcagagatgcaatttaatttctcctgatagcagtatatcttgaaaatattttgcttaaagatttatttatccttgctgtcaatttgtttcttataatttgcctcatagaaacattcattcaaaacagagtgctgaaaccaaaatggaatatacaattaaaaccaaataatttttttcctgctaactacttcccagcccccagactgaactcgtgattgaggttctatttacttttgcaaacagatgaatatttttggagcagtggaggtaggagcatggtacctaagtccaagttgcaccattttgtgtggctgtttctttcttattttgcattaggaaacaggtgcaagaaaaagaaaaaaaattccacttcatcatcgtagtagtatctggaatctcattccccataaccaagaagaactcatttattcttggccaccctctctcttttgttattctaagttgactgtggacagctttgatgctgcccctgaacttctatgagtccccctgcccttgctgccaggattttagaatctacccttctcctatactaggagtggtaagaaaataaattcgggtagtagtgccatttgatgattcattttctttttatatgtgtcctttaaaattaacattgacaatttggagcccctttgtaatgtggatgatagaggaaaagctgtgattgcttataggctgaatttaggttcatctgaaattatgatgtatctcagaaacatcataattccttggtttgggagtggtaataggattaggactgttgagactgtagaaaaagcacattgtttttcttagatgtggatgcttgtttggggtggtgtaggctgatggagagtatttgagacagcggctactctttcttttttttttttttttcccagctgctactctcaatgcagacattgctctagaacaccctgtataaactatatattgccacatctaaaccatatagtacttcattaaattttgaacatttaaaatattttaactatatgagacaactatgtggtgcatgtgttaattagcttgattgtgataatcatttttcaatgtatatgtatataaaaataacacattgtacactttaaatgtatacaatttttgtcaattatatgtcaataaagctgtaaaaaaattttagataatgcacaatggatcccatactttgtatttattcctatataccttgatttttaagcaccttattctttaagttcattttgttgccgaatttgagtgcattctccctagtccttattaaagagggtacaataatctttcatctgagatacaattgatggaattattttataggatcgagtacattttaaagcctaatctttctttgcttacattgaatattatgaccataatattatgaaatgttattctgaaacttggtctgagttctcttacgtcatcagaaatttctgcaaattcaatctgaaatcaacacatgggcactttttttttcttttttatggtcttaaatacagaaaatcataatctattttaagcttagataaatgatggaacacttgtttacatgggtaaaatgactctatctaagtagtatattgaagttcatgttaatgtttgctatttaatgacacctaatgatattcagtgaagggttatgctaaaccggagagaaaatgtgttacccaggcaactgcctctggcagactagagattcgggcatatggctctatagtacacattatttcagcatctttaagcataaagaaccacacatgtaattgactgtgaaaaattactgctcagttactgtattgtatggtcataatagaagtaaatgaatacgtcattgttgttggaacaagtctgttgggaatcacttgtagactctactatttaagaagcaaaaatacaataagaagaaaatagctggtttaattaacatgtaaaaattgggttaatttgaattcagctggcacagcagatattaatgttggcttttttttgtgatattctggctcaagcctgggtatttttatttcttcttgcccacaccatgaataattttatttcttaaaatgataagggctatttcagtcatttaatttttgctttgccagggacttttattacagtcacatcaagagaggttttgtgtgtatccaaaatgtaggaattacagttgaatgaaagaaaatgccaaaatgttcccgagtaattgataatgtttctcaaagaggaatcagtataattttgatttcatgtattttttaaaaattttagtttactgctgatgtatttttatttttttaacagtgacaaactaggaattgatcaacggcagatgcaagaaaatagcatgttcttgtcactttttgtgtgcctatgcttatgtgccttttgttcgttttagaatattgttttaatcatcattaccttgcttcagagattcagaaaaacctattgagaaaggcattgtgttccaattaaaaaatcgtttagctcaatcaatttttggtattttaaaatgttatttgagctgagaacaaacataggtaatatgggcattaactaaaagtatgtatgggaacattctgttccttgggctgtgccttcggtaccctgtaggtacttttgtgcttttcagccctaaatcaagggaatgatcaaactggagactatggttagagaagtgaaggatttggcagtgtgtgcccttgcatgcaggccagtctttctgtccttgggtgcattcaaagtacctggttatccagtggtaatgagaataaaccaacatgctgctttatatagtgtaggccagtatacgctgacaaattcatatgcctgctggcttttcagttactgatttcttatttgtggtttccccactatccttcttcatttgccattttaataacattgagacctttttatccagccttaattagtagaacaaagaaagatttaggaaacctaggtttttaaatctgctttatttgccttaatcagttttccatcatggtttacaattacttttcccttttttcctcaatggtctttctttacctcttttgatttcctcctgctttgaaggcaatacgtaatttaaaatgaggtatttatggtgttttttgtttgtttaaacttagtagacttttcctttaaaaagaagtctttggtagatctcaaaatatccatgatgtaattaaaatgcagactatttgtcatgcacattattaaattctgctctcagtgttggtaattatacaaaataggaacaatgtagtataataagatagcttttcggggtttttaaatgatgtctactagtatttaagaaataaaggatatttatctaaagaattgtggagatggtgaatatgatttgtctctagttttaaaagcttgtaggcttgtagtggttcttttccttgatgtagaatcatctttgtagggattggccgtgatcggagcatttttgtgacttgaaggttaaaagagaggttgagggaggtggcaaggacactggggcagattctcctcatctcattgagtaatggttattttacagggagggaaagaataaatggggtataggaagagtaaagacattttctagtgttacttgaattaactacgtactagcaagtgagaactagaaaagggatgaatcatacctgtcaaatgtgcttgatccatcttataagaaagagaatgttggaggtataagaataccccagtaaatccccctggttggcacagtcagccttgggcaacttgactgctgtttggagtcagctgcaaggcgatgggctgccaagtagagctggcagtatggacagatcacttactgagttaagctcacaattacgagagcctatatatatatatatatacttttgccaatatggaggcagtgatatatgcagaggtgatatttataggccaaatttgtgataacgatacagtaaaattgccaataaaaatctttaataggtttttaaagccaggcagtagcctgcttgtttgaacaatattcaatctgccagatttcactggagccaatgaatttaaataggcccttggcaaacactgcagcgagatttgaaccagagtacatagtagagctgaagagccctgctggcctcagaacacatgcactccagggaatgccaaggtcctttctggagccagggtgggcacagaatggctgcctgtaacctaaaatggaagaaaacaggattttagaatgaaaggcatccgagaaaagcaccttttatggaacaagaaaggatatctgttccaacttgtccaacaaggtcattcagccagttaggcaaaggtaagaccctataggactcagcttctgtccaccttattcctgatggtttttagaagattgggtaatcactcattgtctcttttcagatcagattagaaacaatagtcatgaatttgcataattggagtcgtgagtcttcgtttgtgtgcttgctgaccatcaactaacatattaaataaaaatctttacttaggagcatcctcttcatctgcctaactggtagtttccatatcctcagtgacttccaagcctcagagtctgtgcctgtgactgccatagcccctggccactgggcctcctcttgatggggaggggctgagcagctcctgggctttaaaaactgcttgctgtgacttccaggacaggacccccccagaccccacgtaattaagccttaacagctgtttagaaaatgtatcccagatttgactgctccttggttctcttgctacgacccaggtttagcctactgtagccgcttctaactgggctcactgcttcacccggcggcccgtgctccacagtgtcttgagtgttcttcgtaacctttctaactctgaggcgagtcacatcactcccctgcataaaacccttcaacagcagctgatttccctaggaataaaatccaggcatccttttatgcccggcacctccctcatcctcatcccctttcccttcccctgccttctctactctccagctgctcgaggtctccctgccctttggaacttaacaagggtggcctgctttgggcgctggcactgatgtttctcctcacatccctgtcctccaactcttttcctggccgctgcttttcaccattcagatctcaatacctcctcaccagaggcttttcctgaccgctttaggcaaagtagccttatctcccaaccccattactctcctgaagttgattttcaagcctggctatgtagtacaatcacttgagaagtttaaaaaaaaaccaaatgagtgtttaggcccctctacagaccaatgaaatagagtatctggggctgagaagcatgattccaaggcgttgctctattttaccctatgcagtggttgtctaattctggaatttttatgtatgcatgtgctcatcctccacccatctgcaaatgtggttccttgaggacatagatgttgtcaattttgaggtatccttagtgcctggggcatggcttatcatataataggaacagggtacacatttgctttgttatcaaaaagagtcagactctggggccggtgtggttgctcacacctgtaatcccagcactttgggaggctgaggcgggtggatcacctgaggtcaggagtttgaggccagcctggccaacatggtgaaaccctgtctctactaaaaatacaaaaattagccggggatggtggcgcacgcctgtaatccccagcttctcaggaggctgaggcaggagaattgcttgaacccgggaggcagaggttgcagtgagccgagatcacgccattgcactccagcctgggcaacaagagtgagactccgtctcaaaaaaaaaagagtcagactgtaaaatattggaagagatttattctgagccaggtatgagtgaccatggcctgtgacacagccctcaggagatcctgagaacatgtgcccaaggtggtcggggtgcagcttggttttacacattttagggagacatgagatttcaatcaattacatttaagaaatacattgattctgtccagaaaggtgggacaactcgaagtggggcgaaggcttccaggttataggtagagttaaacattttctggttgacaattggttggagtttacctaaagacctgggattattagaaaggaaatgtctgggttcagataaggtattgtagagaccaaagtgttcattgtacagatgaagcccttaggtagcaggcttcagagggaatagattgtgaatatttcttatcagacttaagatataatgagacatgtccaacccccacttcccgtcatggccagaaacagtcttttaggttaaatttgaagagtgccttggctaagaaggaagtccatcaaggggtcttagaattttatttttggtttacagcttggttgcctgaataatgtgtatttgcaaggaatatgggcgggaaagagaagagctataaaagccaaaagctattaaaagatgttaaaaatcatggagaccaaagctttggataaatttggataaactggtgatcacaggagagtccagttccagatttttcttaacacccacatatacttgtgtggtctgatggttagaactgtgtttttggagttagattttactttcatctctgccattgaccctggacaattgcttggcttctgctgtaacacacagaagaggtataaggagaagttatttttgtgaagtactcttgtggttaggaaccttcagtaaaagtggtaattggattttgatggtacattgtctacaaccaaacttcctgaagtatgaacagaacaattcctatgtgctgttgcttaaactttcgtagccacagagttggcctggagataggagccaggcaggagatgaaagggatcacatggggtctaagcctctgctgagtgagaataagcgaggacagagaggaggagaagaactggaggttgtccgttagtgtgattctttcagatcctttgtttcttttttcaatttgtcttcctctccccaaatctcttatatagtcctcctgccactatctaagttgaggactttgctattttgtttcatatgaatttttatttttttcttactgtaagaacagtgcagtatgtatattattgaaaggattagaaaatatggacaagcagaaaaaaatcttaaatttctaacaatttaaccacctagagatgatatccactgccaacactttggtgtgccttcttcagactttgtgtgtatgcaaaatattattgtccatttttaagaaacaaataattttctacacatcattgtgtaaatgactttttacttactaccatggatttgtttataacactttttagtggttggatagtatcctgcatatcaatgttctgtattcagtccatcacatattgttgtatattgaggttgtttgtacttttttcaccattaccagcagtgctgggtaaatatccttgtagattaaagtttgcacgcatttatgaattattttttaggataaactcctagaagtgcaattgtggtggctgaggagtaaagaggtgtttttttgtttttgtttttttctaactgcttcttgtggggcagggctaacccataggctacccagagtggccataaagacatctttgagactcttgctgtgttgtcaaattgttctccggagatgctgcactcccagcccttggtataaagtgcctttctttctttctttctttctttctttctttctttctttctttctttctttctttctttctttctttcctttctttcttttcttttcttttctttccctcccctcccctcccctcccctcccctctcctctcctttcggctttcgtagctcttccctggattctgccatcgcatctcctcaactctggtctcttccccttaagttcatttaacactcctctgtcagattaaatgttctgatgcacaaattgatcacatcactaaaattatcagatcttggtctaccatcacaggacctcataatcaggatgtgagcaactttgtagggtttttttctttcttttctttttttttttttctagtagatggtgtctcactctgtagcccaggctggagtgcagtggtgcagtcatagctcactgcagtcttgaactcctggactcaagtgatccttctgccttggcctcccaaagtgctggaattatagacatgagctgccacacccaaccccggcactgtattttctgttctagttttcctccagcaaatatggatttcttgtgattcttcatctctggtcttccttccttggtacctggcttaccttctgcccctctggaccaccatttctggggagcagagattgcgtccctagaactgccctctgccaaacatgtagaataggcattgaagtcaaactgcagctggtggactctcctcccgcatctcccatctttacttgatcacatttcacttttattgcaagactgagttcatgttcaccaaacacatcttccttctggtgtcatgtgttcgcaatttcagtaaggctttctccatctcctttcactcaacatgacagtaatctttccctcctctgaattcattgagtcatttatttccagttctcttatgttacttaacctactttttccataatatcacaatttttagtctgtattctctattatatttcagatatctccaggctaagtgctatcccttgcaaagctggggggaggagggacctaaagttacgctacagtgaagaagcaccatcatcattttggtatatatcttgtagtacctttccacatatgtgataaatgattaatatttacattgtgtaagcatagcatacagatgcaattcacttttcaactctttcttctttggcccagtattttatagtactacgcagtgctttggctattttattattacttggactataaaggagttacaaagtcgctactgttataaatggcttccagaaggagaacagcagctctaatgctttgtaaaacaaaaatgacttgcttacagaaaatatctagtagcatcagaaccatgaaatagagtagttagaaacctaccctcccctaatctctgagtggtataggcctgtggaaatgtgacttgtacatttgctttcatgttagctgacccatgttctactattagttcctgcagataagtgtggtggcaaatactgttccttagattctagtcatagagttaatcagagctgcatgattcattttaaagggaatctaacattgtcaaagaagttctgggagttgcgggtggaaaaggaactaagtgagttcaccagccaggtctgaacttgattaagcttgaattctttgttgtaacttacgttaatgctcattaaatctgtaaagcaagacggaagcactgtttgtctatatatatatatgtatatacatatatatatataaacatttttaggtatcatgctgtaaagtaatatagtactacataattattctcatggccttctagtcagattaccttgaaaatccaaaatgatcttggtgaacaataatacattatgattttatggttcatctatatacctcctgcatagatgtataatactcatatctaacaggattaccaaattacataccttttggtatcagtaacatgcctgaaataccagagtatttattggctattctcagttatgaaacattaacattgccagacaaggctttgtatatacatacatacatatatatatatatatatatatatatatataaaatatatagtcatatatataatatatattatatatatgtctttatatattataagctttgcatatgtatatggtctcctatatatgctttttttatataagccttttatatatattaagcctttctttattcagaccatgaaaccaaaaacatcccttttctagataacgcatagtgtgattctatttaatgaacctaatgtctgtgaaggggtaattaagcaaatatgattgttttcggcctcaacaaactgccagcaagttcccctggagagcagcactgtgtggctgcgtggctgtgggtgcctgctcagcagggttgggggatgtgaggaggcgtggcgactgggaagcaaagggccagaaacacatttgtcttctgtccggcttcagaagtctatagtgtggcgggcctgtcggtgaattcctcaaggtcttcttttattacagcatgtcttaaaaggaaaaggaaaaggaaacatctctaaatgaaatgcttgtgggcacttttattcacagctttaagtaacctttctttaaaaactgccagatctgtgtttccaatcttggcctctatattagtttcctcaggctgctgtaacaaagtactctaccgcaaactgggaagctttaaaaaaaaaaacaaattagttgtcctaagttctggaggctagacatccaaggtggaggttcagcagggttggtttcttctgagggctgtaagggagaatctgttccgtgcttctttcctgtcttctggtggtgggcgggcaacctttggtgttccttggcttgaagaagcgtcaccctgatctctatgttcatctttacttggttttctccttgtgtgcatgtctgtttttaaatttccctgttttataaaaaagactccagtcatattggattaggtgcctgccctactccactatgatctcatcttaactagttccatttgcagctaccctatttccaaataaagtcacattctgaggttctaggggttgggatttttggggacgggggacacagttctgcccataccagcatctctcttgagtccattgggtctcttttggcttctggctggacactgtactacatgtcccactgttacctcaaacacagtcacagttggttacattctcccacaggtcccttctttccaatttttacctttttttcttttttcttgtttatctttggtggtggtatcatcatcccactcagttatccaagttggaaatgttgggaacatcctggcctgtttccttggccttggcctccaacatccagtcctaaccacattttataatttctgcctctgctgtgtttctctagcctttcttctgcttccattcctagggcccccactcaggtttagaaccctgtgatccctggctgccaggctgtctcccacatctcatctctcctttaaattcatcttccacaccagttctttttctaaaacaaagttttgaatgtgacatttcttaatccagaaactgagtgatttttaactgtctgaaaaaaaagtcaagattctgttgcttggcccttaaggtccaccctaggtggctggcatctcgctcttgccagtcttttgctcctcatgacctgctagatggagaattggtaactcctacatgcttctccaaatacagcacatccatttgttttcatctctgtactttgcttccccagtgtagaatgtcctctctctacccttccctcctctctccattgtcaccaaaccaaagtcggtccatttgcctgcacaaaatggaaagccaaacacaaagcaccagttttttgcagcaagaaagtttattgccaggcaactgagtaaggggagaggagtcacactcaagtttgactttctctaccagccttacagccatagatttaagggagggcttctgagtgtggagtttaggtggtgaacagtgattagtgattggctgaaaggaaagggggtttggaaagtgtcttgggcatgctgttgcccttccatgctgcttcatgggttgcacctttggacagtggtggcattagcttgaactgagggtgagtttttggccctctaacgtcaaaaggttactcaacaggagaagaagtctattctgcccagactccagtcagctatgttggttccaaccagcctcagtctgtcagccaattttgtggcaaacagagagaactgtaacaaatggttttcttctctgctgtcctgcaagacaagcttaataaatttttgttagttaccaaattctttaatcctgtggggcatggtttcaccatcttcccacagcagttggaattctacccaggttaaatggaagccaggagacctggttttcaggccaaaatgtcagaagccagttgttttgcctaacccaggtcattaactttttccagtttccgtttcctcacaagtaaaatgaggaggttgaagtagataatccctaagatcttctcagctttaaaatttgttcttcaaataccatgccgccatgaagcagtccccaactcttccaggcagaataattcaccccttttatgccccttagtgctttactttttcttttacagttaactcttaatttctagtggttatgtgtgctcatgactatctccccttcctccaaacagctggtggtaagctcctggagttcagccaggaatgcttgactcatatttgccccccttcttgcctcctacgcagagtctcggtgagagagaccttagtagaggataaaatgtccttgggaagtactcccctgtaacacatgctcttcctgagtgttcccaggcattgagaagcatgtgttttggatggttaatgatacagagatgctatattgaacacactgcgtttttcctttctttgtagcattattgtaattgggtgacattctgggaaacagctaagttcactttgtaacagtttttataaaaatgtgttctctctataggatgtttagaagtaactaagttttctgtaaaatatatgaaaaccattcctattttcttcctccttccatatcctccggaaacttggagtatctcaatgtatcattaaagtatttggatacttaaaatagcagttgttaaaaaataaaatctaggaaagcttttatggacccatttcctctttggaagtcaaaacgtccttggcctctcatgttcttcctaaagcttagatttgacccacattttgaccttcggaaagttaaagtcactcctttttcctagagaagaatgaccaggcccttttctttcttcaaggccacctctggtcctatatttctaatcttattttacattgttcttttatgcactccactgtccagacaaaatctgtcactcatcagtttccctgtacactccttagctttcttgcattagccttctgcctgaagtgccctctagtctacacccattaccgcatatccaagttgtactcattttttaaggcctagctcaaatgccatttctgccacaaagacttttattaccatactagttcttgtgttatgatttgtccttcctctatacactagtctgtttctagaccagtgctgtctgcctcactagactagaagtcccttggggtcatgtttcatgtatcatttatctgtattccccttgtactagccctaggtcaattcacaggtggtcagtaaataccagtagtgaatcaatatctgtgaaccgttttttgcatggtgtataaggatactaatgcataacaaagttgctctattttgctgttaggcagtcacatcttagtctaaagtatctgcacttttattatagaacccaaaaacatgcctgaaggaagactgaaacatatatgatgctggataaaacagttatatttgaaattataatgtatttagtgtgtaacttcatggtcaatgctgtcatgtcttttagattctgtgcattattatttcagtccactatatgtaaaagtaaatgctaaatgtttataaatgttttcagtttgaattttatgttttggcagtgatatcttattttttccctcagtgtatgtttgtatatgcttctgttttccacaagctactgacttttgctttatgtttgttttatgttgcagattaatatcttttcaagaatttgttgcctttgaatctgtcctgtgtgcccctgatgctttgtttatggtagcctttcagctgtttgacaaagctggcaaaggagaagtaacttttggtaagaagcatgcttctgtgcacgtctgtgtaagtgtggacttgtgtgagcattttcttttttttttttctaggaacaaaataaagtgtatggaaattctttatagaagatagtatatcccttttagtaaagatacttcaatgttttggagctccagttcaaacatcttcctattcgaaaaaaacaagtttctggcttagtagttttgatactctgatttagttttaaggtgagggagatgtggcatgactgttttcatagagtcatagcatgtgagagccagacaggacttctgtttcttccctgcatcatcagtagtgctttccactgatagaacgaagaagtgaataatctgcctacacacagaagttacttatgcaccctatacttcttgtcttcacgttgttcccatggagtagtttgcggccagagctgctgcacaagatggtggttcagaatggtacatgaaggaccttgttctaaacaacccccgctcccccgacctgactgctgtgctggcagtgtctgctctcctgtggccttctttattttgcaaggcacaaacatcatcatgggaattagctacaaagctgcagaaaaccctgatgtttttcaaattcttagaagaaagggaaggcttggaagtggtgggacagtggtaagttattttttaaaaaactggctactaaggacagatttaacggaaagtaccatgtttcccttggactctgtggtgtccagcatatgttgtctctgcatgcaaatctgcagtagcattgctcatgaagaattttggagccctttaggcatgtggattgtgctttcatgagagatggctttaaagattagggagaatgtggcatgactgttttcatagcgtcatagaacgtgagacccagacaggacttctgcctgtcttgtgcttggcatgtgcccattttaagtgtctctattcatagtttctaattcattcagacctttgggacttgtcttatttgatgtattgtggaaaacatacagatatgggaaaaatacagatggtgtaacagtgttgcttccagaatcagataagcttagccccttccagctctgctgctgttgtctctgagccaaattagtgatcctctccagtcctcatttatcttatcaagaagtgaatataataattagataaagtattggtaagatagtataatagatttattgtgccaacccccttcgccattccgtcatactcatttggcatgacagaattaaaggttaaatcatcttgagcaaagacaaaaaattatatacttgcccggtttctagaagatcagatgctttccattaatacttcatgaggattatttaatatttacagatcctcagaagaaatttatttccatcacccagttcctcttagcaccactgcaaccacaacttttcaatggaataccaatttttagaaagtccccatttaaatcttcaagtaatgagtaagcagctagctcatggtgttattgatttactcaatggaagcgagtttggtgacattgttataatagcgtttcctggggatgaacagaggaaagcctgtgagtgtaagcatgttcagcataggtgtgttctgtcttgtcctcctactttccccagcaagtctggatgtgaggaatggaagagagttcgatttgatattagaggactgagaaatgggcttcaggtagttccttgatatagatccatcttcccttcatgcgtgtgaagtggcaagggatattggtgacaccagctttaccactggtcctagaaagacgtaggagacttccaccattgcagggcaaagtgtgtgtgttagtgtgattagaagaaaatgatagtgaagaagcaggatgtaggaaacaagagctgtctttgaattgtagaaggcatagttgcataaggattttgtttctgcttcttactagctgaaggacaagtcatttcaaccctctgagctttattttcctcatctctaaaatcggggtaataactactttacaggactatgtaaggattaaaagattcactgcataaaaggcactgtctgaaaaacaaaggcctttatacaaatagtgatactaaaagaaatagcctaaaagaggaaaagattttctgtttttttttttttttttcatttttctttgggaagcccttttttttaaaatttttttaaattttttttttttaacgtaagttcaggggtacatgtgcaggtttactatataggtaaatttgtgtcacaggggtttgttgtacaaattatttcattactcagatattaaacctagtacccattagttatttttcctgattctctccctcctcccaccttctaccctccaccctctggtaggccgtaatgtctattattcctctctgtgtccttgtgttcttatcacttagctcccacatatacatgagaatgtttggtttttggttttctgttcccacattagtttgctaaggataatggcctccagctccatccaagttcctgtagaggacatgatctcgttgttttttttaatgactgcatagtattccatggtgtatatgtaccacattttctttatccagtctatcattaatgggcatttaggttgatgccatgtctttgctattgtgaatagtgctacggtgaacatatgtgtgcatgtgtttttatgacagaatgtttatatttctttgggtatatacccagtaatgggattgtgggttgaaggataattctgtttttaggtctttgaggaatcaccacactgttttccacagtggttgaactaatttacactcctaccagcatttacactcctaccagcagtgtataaatgttcctttttctctgcaaccttgctagcaccagctattttttgactttttaatagtaaccattctgattagtgtgagatggtatctagttgtagttttgatttgcatttctctaattaccagtgatgttgagcctttttccatatgcttcttggccgcgtatatgtgttcttttgaaaatatctgttcatgttgtttgcctacttttttcttttcttttttttttttgagacagagtctcactctgtcacccaggttggaatgcagtggcacaatctcggctcagtgcaacctccacctcctgggttcaagcagttctcctgcctgagtttctcgagtgcctgggactacaggcgcgcaccaccacgtctggctaattttgtatttttagtagagacgtggttttaccatattggtcaggatggtctcaaactcctgacctcaggtgattcacccgcctcagcctcccaaactgctgggattacaggcatgagacaccacgcctggcctttcccccactttttaatggggttgttttttcctggtaaatttaagttccttatagttagttgctggatattagacctttgtcagatgcatagtttgcaaaaattttctcccattctgtagggtgtctgtttactctcttgatagttgcttttgctgtgcagaatgccctttagttaattaggtcccatttgtcaatttttgtttttattgcaattgcttttggtgtctttgtcatgaaatctttgcccattccactctccagagtggtattgcctaggttgtcttccaagaatatagctttgagttttacacttaagtgttgtttgtttttcagatgaactcttgctctattgcccaggctggagtgcagtggtatgatctcggctcactgcaacctctgcttaccaggctcaagtaattattgtgcctcagcctcccaagtagctgggagtataggcatgcaccaccatgcctggctgattttttgtatttttcagtagagacagggtttcaccatgttggcgaagctggtctcgaactcttgacctcaagtgatccacccaccttggcctcccaaagtgttgggattacaggtgtgaaccgtcatgtctggccacatttaagtctttaatccatttcaagtttatttttgtatatggcgtaaggaaggggtccagtttcagtcttctgcatatggctagccaattaacccagcatcgtttattgaatacagaatcctttccccattgcttgtttttgtcagttttcttgaagatcagatagttgtaggtgtacagccttacttctgtttataagtatcttgagatatcaacaggtatatgacagggtgttggtatgactggtaaattctagttaatttgtgattctgtatgtgaggagaaaaaattaaatgtttccatttgtatttttagcctattgtatgtgacagtgattttttaaagtacactttgttgaatgacagcatacatgcagaagaatatacaaatggtgttaagtgtacatctttctgaacttttacatctggatctgcttaccacgagccagatcagaaagaggatggtaccagcagtttagaggtctcatcccagtcactgttccccaatcccaatggtaacaactgacatttatcactatcaattggttttgcctgtttttaaacttaatttaattggaactatatagaatgtactcttttggtctggcttcctttgttcattttatttgtgagattaatccatgtcgcatgtattttttgtttttcttcactgtattgaattccattatgtgactctatcctaatttatttatccattctattgttgataaacattttggaacattttcatttttggctgctgcaagcaatatgcttttgacattgctttacatattttttggtgtgtatagacatttctaggaatagacttgctcggtcacagaaaatatgtatatttagcttcagtagagcttgctaaaatgttttccaaagtaatggtgtgtctggaattggtgggttcttggtctcactgacttcaaggatgaagctgcggaccctcgtggtgagtgttacagttcttaaagatggtgtgtccagagtttgttccttcttatgtttggatgtgttcggagtttcttccttctggtgggttcgtggtctcgctggcttcaggagtgaagctgcagactttcgctgtgagtgttacagctctttaggtggcgcttctggagttgttcattcctcccgtccagagttgttcatacctcccggtgggttcgtggtgtcgctggcctcaggagtaaagctgcagaccttcatggtgagtgttatagctcataaaggcaatgcggacccaaagagtgagcagcagcaagatttattgtgaagagcaaaagaacaaaagcttccacagcgtggaaggggaccagagcaggttgccactgctggttcgggcagcctgcttttattcccttatctgccccacccacatcctgctgattggtccattttacagagagctgattggtctgttttacagagagctgattggtccattttgacagagtgctgattggtgcatttacaatccctgagctagacacagagtgctgattggtgcatttacaatcctctagctagacataaaagttctccaagtgcccatcagattagctagatacagagtgctgattggagcatatacaatcctcctgctagacataaaagttctccgagtccccacccgactcaggagcccagctggcttcacctagtagatcccgcactggggctgcgggcggagctgcccatcagtcccacgccatgcgcctgcactcctcagcccttgggtggtcggtgggacctgggcgctgcggagcagggggcggcacccgttggggaggctcaggctgcatgggagcccacggggttggggggacttgggcatggcgggctccagctcctgacagccctgccccgccgggagtcagctgaggcccggtgagaattcgagtgcagcgtgggtgggccaggagtgctgggggacccagcacaccctccacagctgctggcataggtgctaagcccctcagtgcccagggctggcggtgctggccatccactccgagtgcagggcccgcggagcccacgcccacccagaactcacgctggcccacgagcactgtgggcagccacggttcctgcccacacggtctatctccacacctccctgcaagcagagggagctggctctggcctcggcccagagaggggctcccacagtgcagtggcaggctgaagggctcctcaagtgtggccagagtgggcgccgaggccgaggaggcgcctagagcgagcgaggactgccagcacattgtcacctctcagtggtaccagttaacactcatgccatcattgcatgatggttttattttagatctttgccagttggtatcagccatttttattttagtgatatctcactgtgtggcttcaatgagcatttatttccctgattcctaatgggttatatgacatttttccatatttattggccatttggctatcttcttcagtcatgtgcgtattttctggatacaagacctctgagggttatatgtttcacagattctttactctgtgacttgcactgtaactcatttgagtcttgaggaacataagtttctaattttaatgtagtacaaattatcagcattttcttttgtggatagctctttttgtgtcctgtttaaaaaatctaggccaggcacagtgattcccacctgtaatcccagcactttgggaggccaaggcgggtggatcacctgaggtcaggagtttgaaaccagcctgtccaacacagtgaaaccctgtctttagtaaaaatacaaaaatgagctgggtgtggtggcagcacctgtaatcccagctactcaggaggctgaggcaggagaatcgcttgaacccaggaggcaaaggttacagtgagccgacatcatgccattgcactccagcctgggtgacaagagcgaaactctggctcaaaacagaaaaaaaaaattctttgttttcctccgggtcaggaagatattctcctatgttatcttccagaagtttgctttcctttcagatttacattttaatctttctagaatttgttatatttttgcatggtactaaaggtaaaggtcaagattcttccctggccctcttccccaaggatatgtcgattgcctggcaccatttattaaaaagatggttcttttctttattgcactgcagtggtactactatcataaatccagtatgggactgtatctgaatgctccattctttttacattattgtatattctccgctaatactatactatcttaattactacagctttataagtcatatctggttaggttttcaactttattctttaagattatctcggctattcttggccctattcactatcaaaacaattttagagtaagtcattaatttccacaaacatcctgctgggatttcacatgctattgccttgaatatgtataatatctatatgtatatgtataaataaatgttttattcctttaagaatttttaaagtttttaaataaaagtttatttaataacaagtgttagtctgtctatatctcactactctggaaattttgagttgatgaacactacaaattttgaaagagaaaggaacacatctatgttatttgttatctaaagatgctggtgcatgtgtacaattttgcagataggactactgccaaggatgaatcagtgctaagtacctcagaaggaaggtagtagaaacgtgagctgaattttatatttgagataacaaataagtattaccttcttaaaagttcataaatatttcaatagatatattttactacatattgaatataatacatttaaagaaacttcagaattatgtgagttggaatgttaccaatactgtcaaattttggttaccatagtggatgggaggggtattcaaagggagtaaatcatggtggaagacaagcagggtaagaagaggaaagaaaaaatgatattaattgcctagtcatttgtaaccaaagcagagaaataataaataagggaataagctgtcattatattaattataaatctgtgctattatgtgaggagacatttacacaaatttgtttttgaaatttaaggtcttttctctttaaacttagtgtttcgaatgtcaacatagttttctttttctttcttttcttttttatggtgttattttttatactagatcacgggtggcaaacattttctataagggtaagatagtaaatgtgttggtgcagtccctgtggaaaatagttatggagattctgacaaaaatttacaaatagaagtaccatatgatccaccaatctcacttctggatatttatccaaaaatcaggatctcaaagaggtatcagaactctcatgttcatcgcagcactgttcgcaacagccaaatgtggaaatgacctaaatgcccatccacagctgaatgggtaaagaaaatttatatacatagaatattattcagccataaagtcctgccatacatgacaacatgaatgaaccttgaggacactacgagtgaaataagccagccacagaagacaaatattacatgattctacttatatgagacacctgaaataggcagattcatagaatcaaagagtggtggctaccaggggctgtgaggagggggaatggggatttactaatcagccggcataaagttttggttaagcaagatgagtaagttctagaaatctcctgcacaacattgtgctgatagttaacgatattattttgtacacttaaaaatctattaagggtagatctcatgttaagtgtttttttccaccaaaaaaaaaagattttattttcattttttgaaagaggtgaggtaattggtcgtgtagatatggggatggaggaggggagactgtcgcaggcagaaaataatagccatttcccgggttctaagcgcggagtctgtttgatacatttgaggaacgttttagggagagagactataaacaaatacaaaaaatatgatgtcagaatatcctgtttgtatgtaaagcaggctaagtgggtagaaagcatggaagctatctgagcagatctagaggagtgaccaaagatgcattaatactgaactggcatgatatgggctttgtattccatgaagggttggagctgtgggggtctggaagtgatggccactttggaagtgccacaaacagtggaggctgggaataacagaggcctggactggagtcatatctcgggaccccacctgggccattccttttttttttctttcttggtttctttcttttttttttttcttttgaaacaaggtctgtcacccaggctggagtgatctgggttcactgcagcctcaacatgcctgactcaagtgatccttccaccttagcgtcctgagtagctgggactacaggtggcgctaccatgtccagctaactttatttttattttcgtaaaggtgagtttaactatgttgcccagactaatctcaaactcctaggctcaagcaatcctcccgccttggcttcccaagatgctaggattacaggcatgagccactgcacactgggctgttcctgagagctaatctgtatgacttggctcccgattggccatgggtgagaggaagggggccaaaggaaaggaagaagaaccaggtggtagctactggtcttgttctgttcccaagatatgtggttttacataatctcatgagagaagtaaggtaaccatcatttttattttaaaatacatgccaacctctgggctaagtatttttggtataatttattatttaattattgtagcctagaaggtctatactattataattctcattttctgtagaggaaatagacatggggaagttgagtaagtggccacagtcatagtgttgcctgtgatggagctgggagagcagcctgatcctggctgactgttcttcactgtgccacactgcctccctctggtgttgatactcatgcttttggagcaagcccactgtaatccagataggtgtcagttagcccattgtggtctcagtctgtatcagacattagaaggatttaatatttttcatgaagtaaagaacaataggcaaatgcattagttacgattttttttcactatggtggaaagtaataaggaagagaacgtacctggcttagagttaccagtgtacatagaaagttgccttggttccagctatctggataacttgttgagatgcacacgatgtgagttttacccagaaaagctttatcttttgatatgaacagaattctgactgaaggggagaatcacaggacgatagggaagggtgaggagatggtctgtgtccaggttgaggatagaggggaaccatagtagaggaggcccttgattgaggggtgcagcttaagagacctgagtacttgggagggtggttgtcagggcaccaacgacagggccgggcccttaagcaagagtaattatttcatatgagaagcaattaggagtcactacaaggtctttggaggacagggataggatcagaatgatgcttggaagagatgatttttgctgagttgactagagtggggcaaagccaggggtaccatgccagtgatcattatttaggcttcacagtatctatgtgaagccagcgtatagtcaccccactttgtgagtggaagagctgaaagtcagggtttggaaggacttacctggtgtgtgagcaggttggtacagacatgttgtgagtgatagtttctcagacactttcctgttactgtatttcttatttaatgttgcggggggtgcaaaacatttccattgtgggttttaagaaagagtacctgtgtggatgtgtgggtgtgtttaatgaaactgtcgatctgaactatttggcatatataccagtgatgtatcttataatgctaatttaagacattacctattcctacttactgatatttcttaagttgttgtaccacattaatagcctagctccacagtagcagagagattgaatactacttttttttttttttttttttttttttcagagatggagtctcgctctgttgccccggctggagtgcagtggcacaatctcggctcactgcaagctctgcttcccgggttcaagcaattctcctgcctcagcctcccgggtagccgggactacaggcgcacatcgccacgcccagctaatttttgtattttagtagagatggggtttcaccgttgttgcccaggctggtctggaactcctgagctgaggcaatccacccgcctcggcctcccaaagtactaggattacaggcgtgagccaccgtgcctagccgagagcttgaatacctgcttttatctgaggaaagtcacaagtagaccccctgaaaattcaaagtatgatctatacaataccagtttcttaggttaaactcccaaatgttttcttgcattatgctattacatgtttctctcttcctttgactttttaaatttatttttcagtacactgaacaagatttcatgaaatatgttttacgtgcaattttaaagttatccttaatacctgaatgtaacccaatttcattacaagtgttggtggtaatgatggtgtgtgcatgtttatgttctgcagtttttaattaaactttaaagtcaagggttctcaactctttgcctggataagtatcagggagtctgtgaatggctatggttgtttgtaatatttcgtctaaatgagctttttttttttcctggggaaaaattgtgtaggttttagcaaatctcacagaggtcagtgagctgccctttaaagataaaagctgctttttatagaggggcagttgaactagtagacatatatcttatttaacacttttccagcattgctgttaaagacattgattgtagaatagtttatgtatgacttcaaaatgtaatgataatcagtttttggatgccttttggttttggatatatgaagaaacaaaatgtatcagacaacctatatataatacaagagacagattggaaaatacatttttctgtaactgaagtaaatgtagagtaactaacgaattattaaaaatacaaaaagagccgggcgcagtggctcacacctgtaatcccagcactttgggaggctgaggcgggcggatcacaaggtcaagagatcgagaccatcctggccaacacggtgaaaccccgtcgctactaaaaatacaaaaattagctgggcatggtggcatgtgcctgtagtcccagctactcaggaggctgaggcaggagaataacttgaacccaggaggtggaggttgcagtgagccgagatcgtgccaccacactccagcctggtgacagagcaatattctgtctcaaaaataaataaacaaaataaaatacagaaagaactgtttggttggctggctagtgagacctctgaaagggaattggttctgattctcatgaagaccaaaatggaagaaactagtctacaccctgtgccacactgggaggcctgggctggctcgccactgcagctctgccagttagcatggagtctgaaagaaactggtccagttttgccctttattggaaactacagtgaccttttgtcctttaatcttcactattgaaatatattgtaagtttagtaactatagagaagcgtttcttgtttatgttaataagtggcatgtggaaaagggctctcctaagagagaatcataaagcctggaacttttaatttattaaggctctgagaagtcctgcggaaaaaataaatctatttaactttgtttaaattgtagtttagcaaacttattatatttgcaccaacttttctcttgtgtctctcccactaaacaaaacccacagaaccggggcgatttctaagctagttaattcttaattctaagcgagtcctcagttagttaattctctgatgtggatgtaattgtttggagggaccctttctgagttcaacttagattgtgtccaggaacacctgctatgatgaaattggtgtgctttgggaaaatgggtaggctagatgacattaggaaatgtgtggaaacacccactcagtcacttcgattcaggttgcagaaaatgatgggagttaaaagtatggaaatgagaagtttcgaagttaagcactcaaatttaatattaaatatataaagctagaggaatgctggtattggattggaagaaggcagactttacccatcatttttaagcttgctggaaaggaaggtcatttgttactgtctttgtaaagacacttcgaaaatgaaatattcgaaaagatagctgagggagaaggtggtgaagaatcagaagaaacgttacttggggaaagttcttcattaatattggttctgattttggtgtttcacaaaaataatgtgtcattttgatgaaagaaaaatattgccctgcagtagatttgattttattttatgagaggtaaagagggggctgagtatattctcttatacatgcttacatcccaaatagagagtaagaatttcgaataagaacagtatgagttttgaaagtaaatagtctctatgttgataagaattgtggcatgcctgggtactgagtatcttttcagagatcctagagactgtccagaaactgttccagttcattgggtcaaaaatccactatttacgaaaagctaaatacggatttgcacgattgaccataatggcttcaattttgaaagatagtagtatcagagagcacttccagttggtgggataatttaagaatcgcccgtgctcaaatggctaaaatattgtactttttgctacttcatcactccattttaaaaatagagagggggagaaaagaaggcagacctgttgagaaggtggaagaatgtcagttggagagcaaatcaaaataaccatgtgaagccactccttagttaactactgcctgaaggttaactgttccttagaagcctgtcagggagtggagagactggactgggggctgctgtccctgtgtgtgcatgtgcacctgtgtgtttgtgtgtgcatgtgtgtgtgtgtatgtgcatgttcatgtgcatgcatgatgaagggtgaagagaacttgtgagtaggaaagaaggtgtagagaacagaaagctaacataaaatcctgaaacttagagtcctaggaaaatttgactattttaaactaactgtactgcttatttaaagataggaaaattataccattcttcttctggtataagagagagataaaaatacagtttttctaaattggaaaatttgctgtaatcttgctgctaatgactgatttcttccaacagttgcaaggcagtttttgctctgataggttgataaaggaaacaaaatcaagaacatattggaaattctcagagaaaattacagtttaggtatatgttgggggtggatacttagacattttaattgaaataaaacagttttatactaatatgggatcactgtgggtgtacatttgtagtacatctgctcttgaagcatttaagtagggttaaatgtatgttaatgcttttgcaagaaaattttcgataatatccgtctaaggaaactagcttaggaaataggtttttgaaaacaatatagatattatatttgcatttagagagtgaattaggactctgtaatgctttaagaattttaaaacattagttgtattctctagtggtaatgaaagttaacaataattaacacacagcagatgattaaagcaagcttacacatctggagagtggccacagtctgctatatgcctctaaacaccattttaattgacctacttttgatattatgaaaggctaataatgatttattctacccagttgaaaatactttttctagcagataattggaaacatctcagttggcccctctgttgatttagttagtgtgtgtgacagatggttaatatcttacgctaaatatctgccagccttgagccattttgttgttgttgttgactcacagtcactatgatgacttaaatagtgtatgaatcttgagaattgatagatctgtcagattatagaggaggagggagtcttatcaatgaggtagaccatgggttctcattgtaatagtgtagaatgttggttaactgtggactccctggctctgtctcaaatctactgattcataatttttgggtgtggggcttgggaatgtgttttaaacaagctctccaagggaatgtagttcctacttcaaatgaacaatggctgagtatagtttatggctttctttcatggatgaggaaacaggcccagaggggaaaaggtgactagtttcataagaatcacaactttgacttctggcactagaaggatagggttctttcctgaatgccacatgaccttaactcaggctagttccatccctaagtacagaactggaagagttttaaattagccctaatttttacatacaccaataccacatatgactttagtataatatttggctcagcttggctgtgtgtgtgcttattttttgaaagatacctatcaccactgtacctacatgttcagaataataataataaaaagtttacaggggattatagagaactcaattttaatgtgaagtacttatgctctacttactatgttttaatggcaaccattttccccctagaagtttcttgagcgactctgaattgtagccagaatacgtctttcctcttcagacccttagctgtgattaatgtaaaaaggcacttgtcaaaagggtttgaaatggcaaccttgatattggagcatatggcagtagagataggtctgcatccacttactccattatgttatttaatgtacgaattcaacaatttgtcttttgctccctgcttaaaagatgatggccgtagaagctggttgttaaccatatcagcagggtggaatattacttcccttagagaaaaaccacaactttctttgaggatttagcatgcattagaaaaagcatgaaactgttcagagataaaatgctgggccttcagcagtcctctctttgcctccaagaggggttacttttatgtttaacacaaacatcccttttgtgtttattgtattaatggaatttttaaaatccatgagaaagagagagagattatggtttagtgtttgaaataatatagcttgatgaatcttttttattttaatgagaaactctttttcatagatatgctgcttcaaaaagtgaatcttttagaaattaaaatgcattaatttagttattctgtatggaaacaaaaacatggaaagttaaaatttgcataagtgaagaccttgatgatttcagattatagtgtggtggaggttaaggaataagagtccatagaatttgtaaaaacaaattcagtctaaccacttaatggcatgtgcaagtaatttgccaattaaatatctctagtgtctgaaagatcttcagagaaaagagtggaggttcttaatctttcttaattttatactttaagaaacataatagaaaattacttagtttttgatcacttttcattcaaaattttagcatatgagctcaagaaaggatggattttaaatatttgaggaaaattattgctttttgagaaattaaaaactatgatacttccaaatcacactgtgctcatttaaaaaatagtatttgtaaatatttggtgcccagataataattttcattataattaagactttatactttggagttttatgattttgatggtcacctactatgtttagaacattgtactagtcatgcttaactccagaaaaactgtctaagatagatattcccattttaaagattgagcgaattgagtcagagtaagtaatttgcccagggttactcattagtaagaggcagatctctgacagttctaggtgttttttgtttttttttttcagagaaagctttgttgagatataatttacccatttaaagtatataattcaatggtttttaatatattcacagatttgtacaattatcaccacattcaattgtagaacattttcatcaccccaacaagaaacctcgtaccacaccttagcaatcaccactcccttccatccagtccctccatcccctggcagttgttaatctactttttgtgtatatggatttgtctattctagacatttcatataaatggaatcataaaatgtgggctttcatgattggtttcttttacttagcataatgtttccaaggctcatccatgatgtagcacatatgttattcctttttattgataaataatatttcactgtgtagatatagataggtcacattttgtttattaatcagttaacaggcataagagctgttcccagtgcttggctattatgaataacgttgctgtgaacattcatgtatgtgagtttgtatgggcatatgttttcatttctcttgagtatatacctgagagtggaattgctgagtcatattataattctatgttgaactttttgaggaactgccagactgttttccaaagtggccacaccattttcttaaatatattcccaccagcagtgtttgagggttgcagttccttcacatcctcaccaacacttcttattatctctttttgattataaccattgtagcagggtgaagtggttatctcatcatggttttgattttcatctccctgatggctaatgatgtttaacatcttttcatgtgcctcttggcaattttatgctgtctctggagcaatgtctgttcagatcctttgcccatttttaaataggattatttgtccttttattgtattgtgagagttctgtgtgtatactagggttccttatcagatatgtgacttgcaaagtttttctcctagtctataggctattttatctttttcttttctttttttctctcttttttttaaacttttttattttaagttcaggggtacatgtgcaggttcattatataggtaaacttgtgtcataggggtttgtcgtacaaattatttcatcactcagatattaagcctagtacccattagttatttttcctgatcctctccctcctcccaccctttaccctctggtaggccccactgtctcttgttctcctctgtgtccgtgtgttctcaccatttagctcccacttaaagtcagagcgtacagtatttggttttctgttcctgcattagtttgctaatgataacggcctccagctccgtcgacgttcctgcaagggacatgatctcattcttttttatggctgcatagtactccatggtgtatatataccacattttttttatccactctatcgttgataggcatttaggttgattccacctctttgctattgtgaatagtgctgcagtgaatgtacacatgcatgtgtctttataatagaatgatgtatatgcctttggatatatacccagtaatgagattactgggttgaatggtatttctgtttttaggtctttgaggaattgccacactgtattccacagtggttaaactaatttacactcccaccaacagtacataagtgttcctttttctctgcaacctcaccagcatctgttattttttgactttttaataaccattctgagtggtgtgagatcgtatctcattgtgttttaacactttctttttttcttttttttttttcttttgagacagtctctctctgtcgcccaggctggaatggaatggcatgatctcggctcactgcaacctccgcctcaggggttcaagcaattcttcctgcctcagcctcctgagtagctgggattacaggcacgtgccaccatgcctggataatttttgtatttttagtagagatggggttttgccatgttgcccaggctggtatcaaactcctgacctcaggtgatccgcccatctcggcctcccaaagtgctgggattacaggcgtgagccaccgtgcctggccattttaatactttcttaatggtatccttggagtataaagttttaaattttgatgaagtataatttatttttttttctgttgcttgtagttttggtgtcaactaaaccatttcctaatccaacatcacaaaaattatgtctatatttttttctaaaattttcttgaaaatatgcctatattttcttctaaaactattcacggttttaagtcttgtagttaggtctttgatccattatgagttaatttttgtatacagggtgagataggagcccaacttcattattttgcatatggatattgtccctgcaccagttttttcttattgtctgttacctttgttggaaatcaattgactataaatgtgagggttaatttttttactctcaatttcattctgttgttctctgtgtctatcttataccagtactacatagtcttgattactctagctttgtagtaagcttgaaatccaaattcgtgccaggcgtggtggatcaagcctataatcccagcactttgggaggccgaggtgggtggatcacgaggtcaggagttcgagaccagcctgaccaacatggtgaaaccctgtctccactaaaaatacaaaaattagctgggtgtatcaaagcgcctgtaatcccaggtactcaggaggctgaggcaggagaattgcttgaacctgggaggcagaggttgcagtgagccaagatcatgccactgtactccagcctgggcaacagagcaagactccatctgttcttctttttcaagattgttttggctcttctgaattgcttgaattttcataatggattgttggatcagtttgccaatttttgcaaacaagccaaccaggattttgatagggattacattgaatctatagatcattttagggagtattgccattttaaaattaactttggagagttttgccatcttaacaatatcaagtcttttaatccgtgaacatgggatgtgtttctatttatttagattttctttagtttctttcaatgctgttttgtagtgtttagagaatcagttttgcacttattttgttaaatttatttctaagtattttattgtttttgaggctactgtaaattgagtttttttaaaattaattaattaattaattaatttttttgcaacggagtctcgccctgtcacccaggctggagtgcagtggcactccactcactgcaagctccgccttccgggttcacgccattctcctgcctcagcctcctgagtagctgggattacaggtgcccaccaccatgcctggctaatttttgtatttttagtagagatggggtttcaccctgttggccaggctggtctcgaactcctgacctgaaatgatccgcctgcctgggcctcccaaatgctgggattacaggcgtgggccactgcgcctgaccgagttgttttttaaatttcatttttggattgcttatttcaaatatatagcaatacagttgatatttgtatattgatttttctgtcttccaaccttgctagacttatttattagttctaataattttttagtgatttcttaggacttttctgtatataagatctgtgacccaacttttaaaggtctcaactcttttcactataaccataccctgtagcctgggaaacttactaacttgggagaaataggttgactttttgaggttatctttaggaagtaaacaactgccactttgtaattgtcttctcatgatataaacaaatgcggcagacttttaagatggaaacttttgtggagaaagcaaggttccacaagtaaaaggaaccttgagcttatttggtgaggtcttactttaaataatatcactattatttggtgatattatgggaactacaggccttccaaacatagcttgtttggcacagactgaaataacaacaattatactttactttaaaaaataagcattctaatttggctttacttttaggaggagtggctgaactaagaaaaatatgactttatatatccaaaatatatactagtgctacatgcacattttaatgctaattagttttgtttctttgcctatatgacctcaacatggggaaaagagtataagccttgtattttagaccagaagagacctaattctaattatttttacatttgagatagatctagcaggtggttcttacctgaaagtcttccacgactgagttacgagttattctgaaccaagtaagcaaccaaaaaagctaaaacatgttgggtttcttctttcctctccaggactgcaagttaggtttggaatggtcagggaatggtacgggtttggtgagagggcaactctaagtttgactcctggagtctttcatagtaaggctcatggaattgcccatgtgggagccagagtatagagtagaactgggcttgaaaatcgctttggattttcatttctgatttttcagctataaaatgagagctgggacttgttcctcttacctctgagagccttacaagacatagaggaatcttaaacaatcaaatgttaagtgagaaagctatttgtgcctcctaaaaggagaaaagaatattaacctgacgtggtattataatgtctcccagagtgagggagaaatgcaaggaacccatagtgattattgagtttatagatgtttctattcatgagcctgcaggaaaacgtagagaccaaacatttcagaaaatgaatgccctaggatgattcattagagcagaatgaaatattcagaaacttatgagtctataaaatatttttggagaaaatgtgtgagttttccagaggaacaagatttaatattttgttttaaaagactttattagttgtgagatgaatagaaatattggtaggtttcctttaatcttttgcatatcatttggcttctccaattagaatggcttggcaatcttatgatatttgagtacataatcctgctaggtaggtcaagagagtaaaaagtaaatttcgtagaaattatgccaagtggtaaacaacttcaggcctttttttccctgcagagtcccatggccaactgttctttccatagcaaacttttcttcaccataaacatagcatcatgccccgggggctttaaaataatgtttgctgctggcaggtgatgccaatgtctgtggctacctggagcaggatctatcatgtctcagtgatcccaggtggctttggtccaaagcactgtaactggacctttgattcacttcaaaagaaatgaacctttcttcatgccattgatcgccattgaaaagctccctcaaaggtccctcttagtaaatccttgacacctttcaggtcccagatcatggtttatctgctccagtaagcttttctctcttacttctctccttaaatctccatttccttaccatgaggccaccctgtggtttagtgctgatacagtgtactgtttgaatctgctgttgaattatttctcaagtattagacttggatgtagcctcataccttttactacccttcctcttcccacaggacctagtacagtgctcccaagctgtgctacttagaaggttgctagctagctagctaagccctgacattcctacaatagccagtatattggaacagccacaaagctaataatgggcctacatcctcagggtcatgtgtttgatacactccccaactccaggaggcaccagtcacatggaccatgaagtgaatgccatccactagagttgtgcagcatgggagccctgaatgacctaggtcacacatgatctgtgtttacacattcctgcattacactgcttggtctggagagtcttctctacctccttccttttaaatttttatccatttcaatgagaagttaaaaattaggagtgaatctaacccttccatactccctgataatgctttcagaatgaggtcctggacccttgcatcaggaaaacctggagtgctggctaaaatgcagttttttcagcccctcaacatgtttaaatcagtttaggaccgggcctggggattttgataaacgatgttgactgatgatttgtatgcagtgcactgaagtggtgagaaatgactgttgaatagtttctcagcaagggaaactgtagtgccccaaagggttaataccgctgtccttaacctgttgcattatctgttgtaaaccttttctggctcatttaaattcagcaactacttagtgagcagttgctctctgcctaccactgtgccagccatagtggtagaatcagatgcgaagaatggggtctttgctgtgaaggggctaataatcaattaggaaataaaagacgtgcaataaatatgcacaaacacattaatatgtgcatacatatgcatactatgtaatgatttatattacatcatatagagatcttttatatacatctagtatagtatactctagaagatttatagagagatcttttttcaaacaaatcattattggtagtacaggcctataggattgtcagattttagatctgagagatatcttagggataatgtatagctctatcctgcagaggagatttcagtacatcagccaggcatttcatagaggcacacacacagtctatggtgtagtccaaaaaactatagcgtttagagtttcggattcaaatgtgagctctagtaagaagtaaatggtagttactttaattatagataaataagattgttgtttatggtgagacacattttacatgcattcactaattttagaaaaacttaaacctactttcatgtatatttataattttagaccatataaatataaaaatggataataagtgccttagctttacataccagctatttagtaaaaaccttctgttactttctatgggaaacagagattgaaggagagatcaagaaggggaaaaatcttatttttgacaattatcctatgattattacgttaaaactttatttcactggaatgcttggcagaaaggaatttttaagttaactgaggataaaccagaaaaccattttttcttgcatattatttctctaaaattttattctagtataaaattttatttacagtgtgaattttttttcttttggtcacatctttatcatttgagcattattttcattagataatttattcatctagattagaaggttatgggagcctttattaaaactttattgggcctgcttcctacagagatacagacacttacacctggaaaggagtcacagattatctcggttaatatgttttgcactgaagaaagtcatgttttaagatattaagggacttacagccattagaacaatacttggcacatggtgagtgcccaagaaattttagctgctgttagtagaatttgaatccaagtcatttgaatttcagtttggtgatttcttctcagaaatcttctacttaattccttttattgacccctggtcagactcactgagaatcttttttgtttgtttgtttttcctttaaatcctaattctggattcacttcattttccttatatcttatctcttttttccctaaaagtaaagaagacagaataaattcagtacttgtactttaaaacttttattgtcctcatcagggccagtctgaggatttctgccatgttttataaaatttatgcccagcataatcctgattttttactgccttctctgtgcaaatacacacctaaccttatgctaatggtggcactactgtttcttcatgacaaggctttaaaaatttctggaaactttaaaaacgtggaataaaaactgtgggtataatgggggtgggagcaggaaatttgaggggaaaccatagacacattatgccaaaggttttggcacttttcagaggactaaataactttcttcttctttttttgttttaaatagaagcaaaagagaaaaaaaggtatcaagcacagtttgctcatagaaatgagcaggtttggtagatatatttaaagatgtgaaagccaggaaaaattattaatatgctaataatttgtatttcctccattctccaaacacatacttttatcaagaggaggaggctaaaaataaaaatagaagctttagaaaagtaaggtttttcatgtttttttcttgtttgtttgttttttctctgtcagtcctcttacagtttttctgtagaggctaaaaagagatcctaagccaggaccagcacattcagtggcccatcttaaatgggattatttgaacaatttgagaactcttgggtcaagccaaaagagtgcagtagaaaatcaaagacttgggctgctgctggcttttctcctcattttctttgtcttcacgtgcagctcgataaagtgttggactttttcaaacacagaaacagccttaggggtgttaaatatgtgtgtcaaattttttcctaatggatttctaaatcttccaaaaacttttaaataacttgttaaaggctatatgtaacgcttgtatcgtgtgtgtgtgtgtgtgtgtgtgtgtgtgtgtatgtgttttcctgccactaagattgaattctgtcctctgtacctagaaaataatcattatttcttgaaacaaaaacaaatgagatgataatagttttagctttctacttgggtttcctacagcctttaggttgtgtgtgtgtgagagacttcttgattttccccccctttattttatttggtgggattcttgaccttgatttcttaactgattccttgagggttcttttatttctgccatagtttgtaatctgtatgtctatttaaaattgaattactttttttaataagaaaaagcgatatccattcaataacagattttatcagaaagaacttcatttactttgttttaatcaacctgtcttttctcttttcagaggatgttaagcaagtttttggacagaccacaattcatcaacatattccatttaactgggattcagaatttgtgcaactacattttggaaaagaaagaaaaagacacctgacatatgcggaatttactcagtttttattggtgggtctagctcttaaaaagttaaaagggtatggccgggcacggtggctcacacctataatcctagcactttgggaggccgaggtgggcggatgacgaggtcaggagatcgagaccatcctggccaacatggtgaaaccccgtctctactaaaaatacaaaaaattagccaggcgtggtggccggcgcctgtggtcccagctacttgggaggctgaggcaggagaatggtgtgaacttgggaggtggagcttgcagtgagctgagatcgcaccactgcagtccggcctgggtgaaagagcgagactccgtctcaaaaaaaaaaaaaaaaaagttaaaagggtaaataagtaaacctggaatcaaattgtgtgtaaaagtcctgattggagtcttgaactgtgatttacttactacatactgtgatttacttactacatacttactacagtttagcctggcaaaactgtcccattgagaagtatttctttattaatatgttgaaatcatagaattaaatgggatttccacagatttatgtagaactcctccatgtttagaaggaatacacattgaggccccgggaaatcaagtgattttctcaaggtcacttagatcaggaggggcaaaattacaacttaaaattttggcttgtgactcgctgtgttactacttaccaatattttgttttcccctggaaatggacagatttgtcttcagcttcagaatcatttcatctgacaccttttatagataagacactagtctcaaacttggctgcatgttggaatcacctggaagctttaaaaactaatgttgcctcagtcccacctctagagattagatttaatgggggcaggggggaagcctgggtatttgagggctatttaaagcttcttgggtggccctcatggagaaccagtgtgctaagggcacttgcgcactttcttatgtgggttaaccgctgtagcagttgtctacatttctggggtgcactttccctaacccagtccctgctgcccttctctcgtgacccccttcccccacccatatgatcatatcattgggccactgatgatgcaaggagaagagtattcacaaaatatgattataacttagttttccttcagcagcattatttaaaaatactttaaatacaacattatcatgtagtcactagaggtcaatatctataggctatatagatgtttatgcatttgctttgtttctaacagttacattttatttatactttattaaatatgtttaaaaagactcatgtaaggggactcatttggtatgtttacattttgggtcttgaggaaaattttcaattctttgttactagaaatgtccttagtgggtatcctggtgcccctggctttttcgtgtgttccagaccttgccagagccctctggggagtggttggaatcctgttctgggtagaggtggagggtgcacgggttgtggtgctcacttggtaaagattttgtggtgtccattcttagcaactagcatttgtgataggttaacttcaataggtacttctctttttgaattttcatggtattattatgattcatataatttgtcctgctgtctagtttgcttttattttccaggcctttggaaacataaacaagatgccctaaacctgcctttgtattttttaaaaacaaagcgttaatgtctgtgaatccctgttttcagttctctgtaaacataaacctacttacgtaactcagatggagaatgtaatgtgagttgccggatttttgctgctgtttccacaggacattgttgtgctgtaggaggcggtattcattttgatgaggaataatgacaataatgttattgagacaaatgcctcaaattgactttatggaacacagcctaattaacttttagttttaatgggatgttagcagtagtaaggatgatcgtgtttcctcctctaagcaagtgtcaattatactgaattgagtagattttcaactgctcacagcagcctctgggccttcctccagatatggggaagccagagtccaggattaaataactcagggactatggttatgtttccaaacaatttgtaaggcattcacttaaatttgacttataatggtaaatggaaacatcccacagtgtcctatgtgggatgattttgcctctgtagccagaatagaagtactgaacttttactagattacaatggttatagtggtgaatgatctcagtcagggccttgcttttgtgtcctagtccagatccggacttataggaattaatggatggaccatgataggctttacctgaatgccagttttaatgtctaccattgggtttcttccttccttccatttcatgttttgtttgcttcatttgaactcttttctgaatgtaggtagagcttcagacctctacttcagatgctttgtttgcttcctttgggctctttctggatacaggtaacttcttaaagatattagtgaatttaatctgctgtgtttcaggctcttgctttgtcaggcaggtatccgcctttctgttcttgggcaggactcagaaataggcaccaactccctggctgatgccaaagctgtgaaggcagatgcttggttgcttgaaatgtgaacaagctgccactgtgcatgctgctacctgtcacatgatgaggaaggggagcagccgtagggacagccaaaaagtgcttgtgatttcagggaacttgtatggcatgtagagacagcactcctctattccactgagggtccctagaagatagctcaggttggttccggccagcacattacctgtgcttattatgtatgtatatacatgtgtgtgattggtggggcagtgcagttctctgcagttcctttttttttttttgtcacttaataaatgttttactatatctaagcaagtgtgagcttcttagaaaccaccatgtggctgtgaggatcttacttgggtcatgtgtttatctgtgtagagtctggacaggtccccacccactaaggtgttggcagtcctgggcattgcttacatggtgagttgctatgtccttttctgtgctttggttgtaaaagtcataaagtggtgaatcaatttgatattatttgagctaaacttgactgatttgtactttgcaagtggtaaatcaattcgatattatttgagctaaacttgactgatttgaactttgcatctagtaacattgaagcaagtggcagggatacaaagcctccttcctgtagtcttcttcctcattggaatggaaagatttcagcagggagtggggtcacatttctcttaccccattatttatactgttacatctgttgctgctattttttaatgcccagttaacttcatctccatataacttcatgaatgatggtatgtgtgaatgtgaatacagttgtatatgtgggtaggtatgtgtattttaaaatattctgtaaacctctccacgtatgtctactcccagctcctagagcaaagcctctaattttatagccgctagttttaaaatagattttaatattctttgtattttagaaaataatttggagaaatttttctattctaatctgatggaactgtaattgataaatagtattaatgggctgggcgtggtggctcacgcctgtaatcccagtactttgggaggccgaggcgggtggatcatgaggtcaggagttcgagaccatcctggccaacatggtgaaaccccatctctaccaaaaatacaaaaaaattagctggacatagtggcgtgcacctgtaatcccagctactcgggaggctgaggcaggagaatcgctgaacccaggaggcagaggttgcagtgagctgagatcaggccactgcattccagcctgagcaacagagcaagaccctgtctcaaaaaaataaataaataaatagtattaacctaaaactcggtattttttgtgtgtcatgatgattactcatgtcgggcaaaccatccaattcagcaaatatttgctgagcatgtcgggtttgtcaataggattttgcaaaggtttgaaaggtgcagagactataatcttgagacactcataatgtaaaaatctaggacttgtatctgggtatatccacctgacagtgcaaaaggagcaactacaagtaagtataaaatgtttgccctatgagtttgttgttttgtagcaaaaacccttaaaggtttgtggcataaaccctaatggcaggtattcacatcctttgccaaatttttttttcctttttcttttctttcttttttttgtttttgagacagggtctcactctgttacccaggctagagtgcagtggtgcattagcgctcgctacaactttgaatgccagggctcaagtgatccacccgccttggcctctcaaagtgctgggattacaggcatgagccaccgtgcccagcctgctttgccaatttttttattgggtgactgtcgtaggcacttgggggcacagaatgaaaggtttctaaaacttttctaccaaattattgtgtagtcagtactgagtcactttcaaaaaagttacaataactaatatctgtataatgtttataatttacaaagtgcttttaaatattatttctgataatagcatcctcccaataacctaaaaggtgattatcattatcacatattgtatgcaaaagaataaacctactctatggtaaaattttgcatttaccagtaattttccagggaaatggcccatagctttcattatgtttccaaagaagtatcccaaaagggtggtaaagagcagctgttctagagcttagcttctgcagtcagatgacaggtgtgtgacaaattcaagaatacgatgccgttcccactctgttgcactttctccagatctaaggctatagacagctattttctgttcctagaagttaccatgcatctgaatggcagtgcccagtcatgcattgctaaacatctagcattcctgacccctacccattaattgccagatgcgatcatcaacaagttcttaggggtgcattgtactgtcatttccaggtttttttgtttgatactgttttataatcttgggtatctattttacatgtaattactttaatttgaaaacagtctacacataggagtttccactggttccaatctcaggatagaaaagtctaggattactacaaaattcaatatttctgttaactagaacaacattgttattagctacctctcatatagcattttctagctaagaaagttcttgtattaatatttgtccttacagtcaccttaggttgttggtgttgtttccctatgaaagctgagtgaacagaagcctaaagaagttttctggatttgttcaagattagacaggtggatttgaagttgaaattaatttttctaaatctctggcagtttttaccccccaaattttagtgtaaaaattatctgagatgcgtatttagaaatgcagagtcccaggcctctccaccgacctcccctcccaagactcaaatttagtagttctgaatagggcctaagaagctgcctttccaataagcatcctaaattgcgatgctctggatggttcaggaaccacattttggcaaactttggtctggactaggcaaccctgaatgtgtaaaggtaaacggctctttatcctaagactaatgggaagtctgtcgaggcaaacctcataagatttgtgcttcagaaggatcactctactattgtgtggtaaatctaatggagaggaacgtgaccaaggagagggagaccggttggttgctttttaagccaagagtcaaacaactgtggtctcagttggatggtaacagtgatgggccagagtaaatggagtcaagagaacttacagggataggccagacaaagcttcatgatttaatgggaaggggacagtcatagatttgcagaactcaaggttgactcttgggttttagccttgggctagtgggaggatggtggtgtttcattgaaatagggagtacaagaagaagaggaggttttaaggaggggctacagagtagtgctttatatgtaagagctgttcacgtgtgttggtgtattggctctgctgcctcttttcaattctttggtgttgagatgatttactgtaggaccctacctacggcccctgtatagttgggttttttgaaggaattttgttctgcactttatgtcgccaggaaatttcttctgtttccaggggtcatccagctattgctctaaaagcatcatccagaaattgcaatgctctgaattgtggagaggcctgattttgaggttgtggattccattccactggctagctaagagacaggatagctgacctgagagggaatgaggctaaaaatcctatctaatggcttctcatcaaatagagtttaagaatgaggtcacctgacccaacagagagctctaatcacaagggcttgagtattttatcatagttttactctggtcctcattttgtcagaagaggatgatgaaacccaaagacatgaattgtagtaaatagagctaggaatagaacctggggatcaaagctgtgtctggcatcccagactggtcattcatattagtaaggatccttgtcctcagatcacgagtcccgtgataacctggttggatgccaaagcatacccatgctagtaatgcaactgaacaattttggttctttttaagaaagcagattgaccattattttggcttcttggtcagcacagtgtagaggtcagcctacttcttttctgtgtaacatgaacattttggttatttagatcctgagccctagagagtagaactctagaagtctgctgctcccgggtgacggtagttgccaatgtccctctacaagccagagattcactgctgctggtcagatgtggtcctggctttttctcaccatcagttacggtttgcgactctatttgtcatagcatcctggtgtaaggcaacaatttcaacacaagaggctataggtgttaaaaacaaaattgctactacccccgcccaaccaccaccaaacaaaacataccttcatccatggcaaccccaaattttctagctttagaattaataagcgatttcatgtgttcataaaaaataatcgcttgtagtagaactggctgaagccgtaattctttacagatgagtggacaattaacaaggtccttgcttaggtttaggtttgagtaatctgagccatttgcctctcccttttgtcccccaacttgtcttgtttgtattagtgaaagtatctagaccatgaatttttttttttttttttgagacagagtctcactctgtcacccaggctggagtgcaatggcgtgctcttggctcactacaacctccacctcccaggttcaagtgattctcctgcctcagcctctggagtaggtgggattacaggctgcccaaccccatgcccagctaattttttgtatttttagtagagatggggtttcaccatgttggtcagactggtcttgaactcctgacctcaagcaatccactcgcctcaccctcccaaagtgctgagattacaggcatgagccaccgtgcccagcccgaccatgaatttttagtggcccaagaacccagttgtattttcattttcactatgtgaatgccttttatgttgattctaagttgtatcaggtggggtctgtgatgtagctttggtattgtttcataaacagcatcatttggtgttctcaaatgaactagtgagtagagcacattagtgttgtttgccttcaactcttccactagatgagattctgttttgtgtccaaatggaagccattgctagtttggtgatgagtaactagagatgtgatcacttggacagtaagatgcaggacacgttccagccacagcacacactttctactctctgggcaaagaaaatcaggattcattgtgctgttgtgtttgtggtgttagcttgctgttttgttgagcagcctgttgtgcagggtttttacagtagcatcctggtaaaaatgaacactctatacagcatctccccagctgttacccactgtgaagtttaacgttaaattagaagagcaaggaaattgagatggaaaagctctgtatttggtttctgccaaggtgttgcagtgcatgctgagccacatgtgacactgcttccaaagacccttttaattaaaggcctcacccagtgaattggggatggaatttcaccctcaactctgacactgactgcatggccaaatggggggtggggggaggtacacatagaacaaaattaagaatggtaactacttatctctctacctattttattgctatgtttcatttttactttgttaaaaaatatgtggatcttcattttaattagaatgtttttcttcaaattagcatagattatgaaaataaagtggatatttatatgcaaaccagtatacaggtactgatatgtgatgtaatatagaaattgtttgggctaaatgtgatatggtattttttaggcaaatcgtctttctacatttttgtttcctgtttcgataaacaattagctgcattttgcccagaattcttctattaccatgtctaaaaaggaattattttgaatcatttccttattaactctttgcttttattaatattttagattttgttaaaatttcaaaacacaaaaatgcaaattaaccagggttcaaaaaatatatatatttattttttggcatttttggctttataatataaatcacctggctctcctgcttgttttgagggactgggttttttgggtttttgttgtcattgttgttgttgttcctgataaattgttctcaggctaaagcacaaacttgcatgtctgaatagagatggagagaatattttatattcaaaatatacctacctgaaaattggagattattaaggaaatgacaggcctggaactattagaagcacgaatgttagacctaaagtagtgtaacccctatatatgtttattctgtacaactagcaattttgaagagtttgattttttttttctacagcagtctgaatgggtgtgttgaagtagttggaaactgctgcaataaaagcctgttgcattaatcatcatgcaccagaatagagggaacagaaaatagttcactggcacatattaaagagaaattgggcctcctttcatgtacttgagtggaactgccttagagatagctgcagaactcctgctcttggaccttctggccttaggtgataggaagggccatttgtcttcagttggtaactgtcttcggcagcagcatttagtaagcacccattgcctggtactgttaagagctctctttagagagacacttcattttctcagctctctggatttgctacaaggtttcaggccctgtgtcttattttctttattcacttatttaggtatcagtttgatttttgttgtctgcctgctctttgtatgcactgtgggatgatctcacccatttctacaatcatctttttcttcatctggtttttggtaggtcccctctaaaaggaacaggcagtctgtgtaggctaacatcatggctccagaagccgactgcctggatgcatattcagtttcatccttgcccgtgtcacccttggctcattcttacctcatttttccatcttcagaacagaggtgatggtaggaccacctcggttgtggagaggattcaaagagatgaagcagggaaaacacaacagtccctgggacatagcatgcacttaataacttagtaaacgttctccttgtgatgttttctctaaaatcctgttatctgaatttcccagatctgtatttctacctgtaccttcagctttcttttgtgtgcctcttaactttttgtttataactgaaactcacttcattccaggtttttcatcatggtcaaccacctcatctctttccccttaagtattttcctttgtggtagagtatcttccccatcattcaaaatgtggatttttgagatatatcttacttcatttatatattcaaatcatcatcaaaattttcttaaagtctcttttcctacctgtccaaatctagttatgacccccttatttatgattttgcctgaggcagcataagttagtagttaagaatctcagttttaaaagctgacatcccttgctttggatcttaactcttccactttttagttgtgtgactttaggctagttacctgacctctctgaacttcaggtgcctctgtgtaaaatgaagataataatcattacttcacagaagtattgtgaggcttaagtgaaatgctgtctttgaagttcttggcatagcccctggtctgtagtgagtgttgaagcattcagcttttgttatcctccatcctggctgatgttcatttttccgttcctgtggctagttcagaatgattgagcagaaccactgtttcatattgcaagagactttagaggtttttaaacctttcacctggacaaaaatcaaagccactgttttttaaatgcctgtcattcatgacctctggtttttacaaccctgcacagtaggtggtgttgtgcctattctgtagaagaaaatctgaggctctaagatgcaaacaatcacctgagctctcccgggtggcagtgtcatgacttctgtttacgctctacccatgcctgttccagatttcttattgtcatcataatgtatggcttccataactccctctattaaagataaggttaaattcttgacatgtgttcctcagcctatggttgaacacgtatttctggtgtcagggaacctgctacttttcaaggtagcccattttactgctgaatagttctataggttaaagacttcttctgtgtactgtgctaaactctgacccctatagcatctctccattttttcaaaagaaatagaggggcagcctaatattttttttacttgatagtcttttaacttttaaatatgtgaatgtaatgattactgcccatattgttctcccctcctctgcacagatgactcgtttacttctgatccccttcattttagaaataaatactattttgtatatgctatatttcatgcatactaaaagctctctgtctctgttttatcccttctgagttgagatctaggagctgtcagtctcttgacaacccatagtatacattcagattttcattaaatagcttttgaggtgcaaaccaggagctttgattttaagtcattctgccatgagtagtgagcctagtcatttatttcaaagaccacacatttctttcatatttacggagtaacctatgtgttagctcccactggcctcctgatttaattttttcctcctttgtctcttggggctatgggaaagagagcaaaaagggagtgaggccaggagaaggccttttagatttggtttctctcctccttggtctctgctactattggtaaaacaatcctgatgctctgggtgtacagaagccctttgccttaatggaaaactttagggaattttattatttttccacaaaaataggcaacagtaaaatctagagcattaaatgcaaattgagtttttatctttccacagctgttaagatttcttagtgtcaaatttattttttaatcaaattcctgacagtagctttgtctgaggttccccatgcagttgagtgaagtattaggagcatgggtagatagagggctggggagtagaaatgctgaggcttgaattccagctttactgcttcctgtcagtgagactttagtttgctcaactgctatagtgaggttaataatagtacctaccttataggcttgcagtaagcattccatgaattaattcctgtaaaatgctttacagcagtgcctgctgcataatacatgcttgctaagtgctattgcatggttgtcatactggttgaggtcatggtttcatttcttcacccggaaggagaaacagtcacgacataaacagatgatcttcagaaggcaacccacgtcttcagaatgctgcttttaaagttggagagccacctaactgcgtgttttcactctgtcctgctatttagagaactacatagatctagcattttgtcttctgtggaacttataatgcccccaatctttaagagctgttggaaatgtattctcaggttgttcatcatcagacttaaaataactttcttactccaacttgaggggtccctgctcatagatgtttaatcatggaagcgtgggcacaggatgtgttgtaacactgtcctaatcacaggtatgtcccctgtcctgctatgtgagcaccagcccccaccttggcatccattcccaatctggaattctggacaggctggtcttagcattgtggcttcctgctttctgaggagatggggttgccagagaaagcggtgccatttttggtataattgtctgaggatctctaagatgttgagttataaactagggaaaatggtaaatcgctgaacataccttctactattgttgagagtagtcttggcttagctagctttagcaatgggtctggtaattcaaaggagactgttcatttactttcaattgaatacgcactgtggtcatttttcactacagggtgtttaacagttgatttcttcttccttaattggaagcactcatatagagaacctcccattgttcaatagctcacgatttgttcattcagttggttttacagaatacttttcactgatgagaatgcctgtcatttattgagcacctactatacatctaaagcattctgctgagctgcatgtataaatgtaagtagatgcttacaggacttcaaaaggttatactgtcttttccttggtaaggtaggtgtaaaggcaggaatgtgaataactgattatgatgtaagatcaaataagacaagttttataattgatattcagacagggggccaccggaagggacatcagttatttccagttataaggcctggttatatttgcctaagtggtaccatttgagctaagcttaaaggaagtggcaggatttcaggagctggagaaaggggcagcagtctacactaggtggaagtaacgatgtgggcaaaagcccaggtgtgtggcaggtctggcaggggtgggcatgggtgataggagatgaggctaagactagttcctctgggggcttgtatgccttgcttcagagacgggtctgtatgatgaagggtcattggagatttccatggagggggagggagtcaggtttttaattctgaaaagcaactttttatgtgtgcatggtagaccacagaggtccagactgcaagcccaagctccagactgacagtcagaaccactgactctcagtgataatttagatgaggtctgaggaaagtctgaaccagtagcatcaggaacaaaaaggaaaaggtgcatttgggcaaactttcaaaggcctaagggacagaatttggtaactggtttactctgggagaaaggaagcttgaacaattcagaatgacagctttctaggtgaggtggccaataaaactacatgcctaataattaagctgtgaacatagaagagagaccaggtttgagcactgggttgggggatctacaatatggggttagcgatgtgtcattttatggcctttacacgatacccacgtggatatattctctaaacagaaattctggtccagcagaaaggaatgagacttgaatatgggagttaagccttagcttttaagaaatccttgagggcttaagagagagagcactctgtctaggagagtagagtgagaagatgtgaggacagagggccaacagatgcttcccatttaaggagccagtggtggaggctccagaaagactgggatcccagaagagagtttcagctgaggcaggctggttcgaaactggcagatggctacaaatgaggagattcttttaaataggataagaactctgattcttactattaaatgtcttatctttaaaatattttaaatgtagacattttcaaactgcaaaagtagaagactataatgacccatcatgcaactgctatttggcttccgttattgcaaatactgtatttcttctttcatctccctgcctttctggggaaggaaaggaagatcgagtactttaaagcagtatcagactcatgtcatttcccttacactttagtttgcacaaattcataaggacaattattttttacataacttgaataaatacgatgtcattatctcactaaaattaaaaattaatttcttaatatcgtctaaaaaaactccattatattcaaataatttgaagtttttgagagccctgttggtgttcctttttttttttttttttttttttttgagacaaggtttcactctgtcacccaggctggagtgtggcggcatgatctcagctcactgcaacctcctcctccccaggctcaggtgatcctctcaccccagtctcccaagtagctgggactacaggcatgcacctccatgcctggcaaatttctttttttttttttttttgtagagatggggttttgccatgtggcccaggctggcctggaactactgggctcaagggatccatccacctcagcctcctcaagtgttgggattacaggcatgagctactgtgtctggctggtgttactttttaattgcatagaagttagctgtcactgcaagggccctgtttgggaaatgagcagagtgttgtgaggaagataataaaatgctctctgcaggaggaatgttccttccatatagtgcacagtgagttttgatgggaggctgttttcttttgtgtacacacttatcccctgggaatagcaacagagctctgtgattggactttctgtcttcagatcattttaattaaacatatgcaatgataccatgacaggtttacctcccctgatccacataccatgcaactacttagagcagtagtccttaatcaagacatatggctctatgcagagacatttttgattgttatgaccttagagggaaggggctacttgtatctagtgggaagagaataggggtacacacgacagccctcccgtaataaagacttaccctgtccaaaatgccaataatggcaaggctgagaaaccctgtgttggagaaatagcagagaagaaccaccactcttttctatctattgttacatcatgtgtttgggtaccaggttgcagttaagaatttttctcttttctttggagagaagttaaagtccctggcagtgtttttcctcagatcatctgcatcacctaagctggggttggccagatctttgaacctacaacacttcattccggttttcattttctttgtgttcatggactctagagagcacggaagtaattgggtttcattgggtagcagagtaaggtagagtgcactttctcaagacatgttcattggtctgagcaaagttctgtctcttggaaggagacagtagcttggtggtgctattaggcagatgagggcttgttagatcaagatgtaaactctctttcttcagtctgattttaaaatgaactgtcatttgtagtaattattaaatgagaagcataaattaagtattttactttctttatttgtaggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgtaagttgtaacttgccctaatgaagtggtttaactcagtaaataaggaattataaaaacaattcttataagttatgtagtgttttttttctgttgcaaacactaacattttaatgtgatcacatacattactaaactcaaacaaagagtgtgttttggctagttttagtgggtaggttaatttgttgtctgggtaatacggaatatcttcgagaaatacattagctttttaaagataaaaggaaaaacagatttgtgatctcatgttaattttgttttagattttgaagtatatcaagggctgatttttgctaatcttcttagatgctctaaggcaaaaaaaaaaaaaaaatagtgcacatgtatatcatttgttagagtagttagcacaacagaaactccaaaccttagattccctttcaccgtgtatgtgtcgaggccacagagttacatgtgacagcagagccctgcagttgtgtttcatggagcctccctcctccaggtgtcagctgctgtccttccctcatgggccctggggatgtcctgcaacattctgtggtggtggttcttaagacctgctcgtggagcaccagaatcaccactaaaaactattaaaactacagattctgagatctcttctaggcctatcatacaccatctataggcgatgaggtcttagaatctaattttgtaaagcttctgggtgattttggtaataactcagttttaggaccaatagcccgtggtaactctccttttgttaatcccagggagaatactgttttcaccatcatctgggtttcccacagtgcttaccataggcaggaactcagagtagcctttcagtttcctttcttcccccaagtccttagttctagagacatggtattccaacgaggcctcttccattctggcactgtgttaatctaactccttttcttgggcgcccccttctctactccatactaaactttcatgtcagctattttaaatgattactaagtgaagatttatgtggttgttaccttgtaaagaagtgctttcctaataaaaatattttgccttgctagggaaggatagaatttgaaactccaaactgaagtctcattcataatggacattctgtctgtttcccttgtcccctgtgaagaaatatggtttcttaaaaattctgattatcagaatttttactagtcttaaccccccatgaaagtatatggcatctcataattttaccataatatgcttgtttgctagaaatcccaccaatgtaaagtctgtacctaaatgattatttattactggttataagtaacttgacaagtcttgatattaatgttacattgactacttttcatagtatgtttgcattgatacaatacagtttttcatgcataagcacacacatgtgtgcatatgtacttatagtttttgcatgtttaagcctttaagatttgctcattagatgaaataaaccaacttataaaacatttccaattgaaatttgaactctaaattactactagtcctgttataatcctacacatgtatttatttagttttctaggagttgtgtatggagagtacaagttctggtcatgattagttgcagttgcttctaaaaatcatttatagcttttttttaatgcaaaagaaaaatacttatagtcatttcttcttgtacatgcatttttgattactttcaaactagttttagatgtatgtacttctgaatcatctataaatcttttgtatatttttcttctctcttgttttcaatttatttgaggctgctggaggtaccacatcccatcaagttagtttctcctattttaatggatttaattcgctccttaacaacatggaactcattagaaagatctatagcactctggctggcaccaggaaagatgttgaagtgactaagggtgagtgagaatatatctgaattctagcctgcaagtattgtggtgtattattattagggtgaagaaggcaactagtactttattatttttctatcccattgacacatattaactatatgataacgtgtgtttttcatcctttgatcagacaaacaaaagcaaacaaaacaatcttcaccaagttttaaacaaactgggcccagcttggtgactcacacctgaaatcccagcagtttgggaggccgaggtgggtggatcacctgagatcaggagttcgagaccagcctggccaagagggtgaaaccctgtctctactaaaaatacaaacattagtcgggtgtggtggtgggcacctgtaatcccagctacttgggaggctgaggcagaagaatcgcttgaacctgggaggcgaaggttgcagtgagccgagatcacgccactgcactccagcctgggcaacaagagcaaaatgccatctcaaaaataaataaataaataaataaataaactgaagacaccctttgaataaggaaaacatgtaaagtttcttaaatattttcaaatcttgctacagcttgagctaaattggcaacctctaaggaagccttcaggtgtatatgaggaattccataaagttgcattggtgacagtgtaagttggtctgtaggcttgggacaggatattatcagcattgtaatgggattaagaaaaaaaatcagagccggtgcggtggctcatgcctgtaatcccagcactttgggaggccgaggcgggcagatcatgaggtcaggagattgagacgatcctggctaacacggtgaaaccccgtctctactaaaaatgtatatataaaaaaattagcagggcatggtggcacacacctgtagttccagctccttgggaggctgaggcaggggaatcgcttgaacccaagagtcggaggttgtagtgaaccgagattgcaccactgcactccagcctgggcaacagagcaagactctgtctcaaaaaaaaaaaaaaaaaaaatcagaattcccttaggaattccacaccttcattaatataaccacctaaattaatataattaataatcctaatttaaccagttaattagattaatataacttcccctcctgggacctatgcatatgaagtttcatatatgattccttattttctctgattggcaatttgaataacatcagatgaccccaagcttttaaactgtatattcaagaacatattctgcacacgctttccaaatggatgcaagaactgcaaaaattcttaccttatttggattgacttgaattctacaactgatgataataataaagttttgtgatgttcactcattccagtgccttgagttaatgctgaatttagtggctatttcttcttgaatctttcccttttaacttttcttccatacagaggagtttgttctggcagctcagaaatttggtcaggttacacccatggaagttgacatcttgtttcagttagcagatttatatgagccaagggggtaagttggcttttttttttttttttttggaattagcttaataaaaggaggttaggaggagggcagcaatcaggagaaaaagaagccaaactgaaggctatactgaaatatgagaaatgaaaaaagggatgtttttaaattttataatgtaaattgtaataaattggtatatttgttgcttgtgtttgtttttcccctacagacgtatgaccttagcagacattgaacggattgctcctctggaagagggaactctgccctttaacttggctgaggcccagaggcaggtgagcaaagaggagcaaacttgcattctggggtttccttagcaggataccccaaccctgttccacttgcagttgcctttgcggcattggtatctgacttaaccatttttctgttttgcaccaaaactctcgataaattttaaaggctgtaaagagaaattgcttagaaatggtgtgataaacaggtatttggcatttgctcatttcttgctaaggtggagtgatttcctaactgcaccagaagcctaatgctccgaaaacatgaaggaggtcttttctcctttcttgaagtctcatgttgagagatgtagcgaaagaatcccgtgttggtgtcactgtgcctgtcggcagctgcacgttgctaaatgaaagccgtctttgctctgtggagcagcccttcatcagcgcatcgtctaactgccatgccttccgtttttctgaatatcaaaatgagataattttgtttagtctggagttacagtttaaaggctttcagacctattttctctgtgaaaggattcataagttatatggaaacaattttaggaatgctaaattttattttatggttaacagaaaccaatctcttgaagttgtgggagtcagaaacttaagacatggaactttctcctttaactcttacccagctttctgtagatcaggattagagaagaaaagccttcatagcatgtgttagtaaaataaatggtgtttgtaaaataaatccactcacaggcgagtgtcgtttttagaaaaatttctccttttaggcagagccatctctgaatcctgtgagacttcgcagtttctggcatggagctctgggtttgtacagagacgccagtgtgaccacaatgggttgctgcaggctacacttttaggactgtcagaccttgagccagggcccccttcttttagctctttcccacccaaatgcagcggtgagttttgtgtgcagcatgcaagtcaaagtagtgggtgtgtgctcagtaaattctaacgagcacctctggaaaaccagctggccttgcttaaaagaggaagccgatttctctgagtgcaggagaaataactataatcacgtgtagaggtggaagcaacactgctctcccttccctttgatttttaacactgcttaggagatgattatctcttcgtctgtatgccaccagctattgtagaaatttggggattaagagaagcagagaagttttttttagatccctcctactcttcagctggcagcggcttcccacaatttttcctttaagctctttgcagcttttgagagtttatgatgggtgcttgttgatactggccatgaaagggttagaccagattgatgagatttatagcaggaaatgattcgctgccgcttagaggtttagagcaattcacaatggccttacctggaataggctttttactgcatgaaccctagtgggcccgacaaattcaagcaagggaggtcgtccacctgtgggcacagcgctgcctgtccagcactgtgcagcacttgtagcatttatcctggacagaggagtgaaggagcagagttttgtctcatttcaagaacatgctacagttctggctttggaaaagttaaataaaagtctaggatttcatttgtcttttaggagaggaattaatggtggtggtaggtccctcctccccccaccctctataattttcagagtattttcactcattattttgatgccagaacatttctaagtattgcatatttatatccctgtaaataaaatattgcttctcttttggatgcatctgtcaaaatgaaggtactattgatttccatctatatagggctacagttggaaacaactcatagaatttgcaaaagaaatgttttgtatcttaaagaggcatatttctatgtaaagctattttcagttaagtgactttgaaggagattccaaatgatctcattgtattagaattgtgttacattgacagcaactaaaattcagtgggttgatagctggggttgctgattattttcattgttcactgattttaattatcatggattctgaaaaacaaattttattgaatgtatgtattcattcaacaggtatttattaagcactgactatatgtcaccctcatttgacaactctctgtgacataaaattactgttttatttatgcagacagagaagtgcagcactctgaaatgttctggcatcaaaaacactgtgaggataataggtcaaaagaaccagaaaacaatgactgactgacctgaagtatgaatttagaaaagatggacaaaaaaagagaaaaagtaacgatcaactgtaatacagccacctagttttagctactgtaaatgttttgagtatctctgggtggtagggaggcaaaatattagtattaattttatatgcatatatatgtaaacctcttacaagcatttttaataaaaagtgacatcattttgtatatagtcttaaaaattgtttttaaaaaaattaccaggaaataggtcaaacatttaaataggtacaaagaatcatatgacaaatacctatctacttaccatgctctttttagcctatgttttcttttataattccttgtgaacatttaatatcaaatattcttttacagtatcattttgaatgatagggttttgttttaaagttattatttttaaaggctatagtcctccgttattggacatttagaatatttcccaaatttttgttctttttgtttaaagagcaaaaatttgggaaataatcgaaatttccaataagtactacaaatgttttttaagtgctacattcttgtagcttgttacatgcatgattatcttctatcctaacttttttctttttgagacggagtttcactcttcttgcccaggctggagtgcagtggcgcgatcttggctcactgcagcctccgcctcccaggttcaagtgattctcctgcctcagcctcccaagtagctgagattacaggcatgcgccaccacgtccggctaattttttatttttagaagagacggggtttctccatggtggtcaggctggtctcgaactcctgacctcaagtgatccacccacctcggcctcccaaagtgctgggattacaggtgtgagccactgcacccagcctattctaacttcagaggttatgtacattttaagggtttgggtgtatattactaaacatctctctatttatgcttgctttaatggcaaatttcagaaggcttgttatcaacttttgccaggctgggtattgccacttaaaacaaaaacaaaaatacatacaaaccaaaaacctgccaatttgattgatgaaaaatgatgtctcattgatgtttttatttgctttatttactttattttattttatttttttgatacagtctcactctgttgcccaggctggagtgcagtggcgcgatctcggctcactgcaagcttcacctcacgggttcacgccattctcctgcctcagcttcccaagtagctgggactacaggcgcctgccaccacacccagctaatttttttcttttttttgtatttttagtagagacggggtttcaccatgttagccaggatggtctcaatctcctgacctcatgatccacccacctcggcctcctgaagtgctgggattacaggcatgagccaccgtacccgacctatttttatttttgagatagagtcttgctctgttgccgaggctgaagtgcagtggcgtgatctcagctcactgcaacctctgccccctgggctcaagtgattctccctcctcagcctgagtagctgagactacaggcacatgccaccatgctggtctaatttttgtgttatattatagagatgggctttcaccatgttatccaggctggtcttgaactcctgtgctcaggtaatccgcccgcctcagcctcccaaagtgctgggattacaggcgtgagccaccgtgcctggcctcagtgatgtttttaactgtgcattttttttaatgagaatttgaaaataggcttataacatcatttttgtcaaaggatggttttgattatattgaaatttggttttaaacattaatagcactaaaatctttttattaataagaacttatgaaatccattcctacttttttccttgacattttagttgtatcatggatttagaacccaatgagtaatgtttaaagttaatgtatggtcatttttgttttatcttcttttctgtcacctgttttcctgctctctgattcctgtgcatgcaaagcagaaggcctcaggtgattcagctcgaccagttcttctacaagttgcagagtcggcctacaggtttggtctgggttctgttgctggaggttagtcatggatgagagaaaaattttcacttttgttattcctattctcttttctctgattttccatcttgaaatgttaaaggacaaagtcttctctagtctttcccaatgccagttatcagtttctacctgtgaggtagggcaagagtaaagggaactcttttcccatacctgcatgtgatcagggacttacaagtggcattttcctctatctacagatcaggccttccaaagacaggttactaatgaggttgggctgtagcaatgtgccttaatttaaaatatctatgacatccttttattaggggatacttgaatgaaaaccctcaattgtttattaaagatataagaaaggtagtactgttttaaaatctgtatttaaaattcaaaacacatttcttttctcagtcttgtccttgactttaactaccttcttctttcttctgacctatcttactttcttctgagataatgatattgtttaattttagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagcatcttccgtgaatttttgaaaggctcacattgtttgcatccttgaagtactctattctccagctaacagggaaaggtattctgccaccaggacaaagcctactcaggattcatgattttcctggaatacaccacaaaaaagataacgaagggttcagtagagctctcttttgctgcttcatcctgaattaaagttgccccttttcttcatctgactctcaacccaatggagttgattcacacacccctctagccaaggtttccccccactgagacagcctgaaacaggtaatccttctttctccaccttttcctttaaccatctaaggttcattaagcaatggaagtagtagcagagagtatgtcatcactgatggaaaggatcccacagaccctgactgcttttccactggcattggccgaaggagacttctcaactgttctttcggggattgccttctacgagaaggaaacagtgtttctgcatcagttaaaatacagtatcacaaggcagttcaaactcagctgctttataatttggcagcggcaaagctggcagagttttccctcctctcccctactaatgctctctctagatgaagaaaacagtatttagtactctgctgaggtggacggtgaaactggcagacatggaaacctgtgcctctgggcctcttctgccatctgctgactctagtcttcaaattaattaccccagttaaaaaaaacaaaaaggataaacctttcttgaaacctctcaccttagaagccagaaagtctcaaactccagagaagttccattttgcaggtcctattgtgtaggtaggtagcccccatcaaaggccttttgatctttgctctgccctcttttccttatcccctgcctcttcttacaatttggaaggtctttgacctcaggtgattgatgatgaccctttcagggtcactgccttccatttgaaatgcttttcttccctgatggcaacaactttgcaaatgaaatggcttccaagtagtacaaggttaatgtcacagttcctattctgcagtgagtcaggcaaaattggccgccttacctgtccatatgggtggtttttggaagggaaatctcgagtctcaagtctgggcagacatctgagcattgcttcataaactactttttgggcttttcttggtattagattaaatgtcaaggatgcctttagaattgtaagaatgcttcccaacactgctcagtgtctttaatttgcttaagttgattttttattttgagtccttttttctcgatctttgaccatacctggcaggtctgatttttggttacgtctatatttcccttttgcaacctgtactgttggcaactagaagtgtgcctgagtactgagtgctgagctaatgtgggctatgcaaagaggcttccactcttgccgtttcagttcttttatctgtaagatgagagtgactgcttttaacttctcagaggagtagtaagtcaatatattaggtacagacagaggctcactgtaaacacccaagtggcagctcttcacccttttcctggtttagaaatggccatttatctttgggtgccccaaccttaagggcaagagacagagctgtctgtcaggatgatgagtagagtgtgaatataagattagttctaggagtcacctgtgttcatttcttcctgatatcttttctggtaaaccattttaaaacaaaaaatttactgtaaaatttttgtttagtcccattctgtaatttggatcatcttgagagcaaaatgatgactgacagttcaggttaaaataataatgatacataactttgccatgaaaatgacttgttcctattcttgattggtcagggatcagttctctttagtttcttgtacatcatcaataattaataattgtatataactgcatatttgtaagtgcttattgggtaagagagatcagatgaaaatgtaggtaactcatggttattgttgttaatttaaaaaattacaatataagtaaaaaagacctgacatatttctgagactcagtattatcacctttatgtacaaagtcacattatgaaatacctatatgtgattctttgtacatttctcataaaatgtaactttattttaaaattatattattccagaggaaaactgttacgtttaaattaggaaaatatagtattgctgctattaatgctttcacctagcaatatttgagaaggtatcagagtacatctttaattcatacatgtttttaaatattgagcatagtttttagtattacagaattttgctcaacatgtaatttttctctatcaaggcctatgtaattgctcatatttcctgaatgagataatttgggaatgttgcagttgtaagatctttctcctactttaaaattacctttgtgtatactttgaaaaaagttggcatctggcctcaaagaaggtgtttttgtagcatgcgatcttattatgaggttaataaatatctctttttcttataacaagaatatcagaagctgtttttgcatttaaaagcctttccctgtggcattagaatgaaggttattttaaaagaactcttgtagtgctccaccacaagttttgttctttgcctcccccgcagctggctgcatcagaatagttgtggaagttgcttggtagtcatgagagagtgcctagcagtgctcttcaatagaaatatacctcagagagtcatgagaggtgttgtgagttggttaattcctgctctccatgtattggtataactccgttttctttatttccaggagcctctctcctatttttgtgtaagttttagttgctggaaaagagctccttaaaaatcccatgagtctggctctgcaaaccttctctacagtgcaaactacttttttcctaacaagaaaatggcaaattttcctagtttgttgttgttgttgttgttgttatttctgaaaatccaacccccaggccaagcctgtctgtattaagggaaatcacacctgagataatccaggtcttcctgaagtcacttttaaaattctttctctgtttcctccccagtcttcagagtgatttaatgtgctcaggtatttgaaatccttaatgaattacctgacaacttgtttggtttgaatgactggcataaccaaatgaatcagtcattggcctgctatagatctggcgtattaaagaacaacaattgattgggtaatcatccataattaaatgctcttaatgttccaggaataaataatttctgcttttaaactttgttgcagtcttctctctcagatctttcaggtgatgagatgagcagccttagacactggaaaatgttttgggagaatcttggggaaaaagatgtattaagagaaatatggccgggtacggtggcttatgcctgtaatcccagcactttgggagaccgaggcgggtggatcacctgaggtcaggagttcaagaccagcctggccaacatggccaaactctgtctctactaaaaatacaaaaattggctgggcataatggcgggcctgtaatcgcagctacaggctgaggcaggagaatcgcttgaacccaggaggatgcagtgatctgagattgtgccgctgcattcctgcctgggagacaagagtgaaactctgtctcaatttagaaaaaaaaagagatagaaatcagggtctatcagaaatacttcttagacgaaaatttttgtttctattgatgggagaagccctaaagaaaatctcccagaaagagtaattagatcattttatgaattaaacttaatttaagcagtgcttaacctttgaggaaattggcaaaaaaaaaaccacattttttaatcagcccattgatccaagcttgcagagttgtaaatatttctatttcaagttgtctgtgtagtgcaaagcagtcatcttccatcctggaatgttctcaaggtgacatctagaggatgttgtggtgatatctcagggagttattgatacttttatattgcagagggaagttttggcaggcagctagtttaagccaggtcccttatcattgatggtactataaaagggagtatccagattctttagaatcacagtgagattcttcattcttgcataattcatggggataaaataaactttaaaattctggcaccaaaataaaatgattgaaatttccatgactgttttgcattacttaagaacacatgcatcttgaaacaaaccatagttaatctgtgaactgcactcatgtccatccatgtccaccaaaacttttaatgattgcaaaatggataggtttgagtctttattttcttggccaatttctgcacgttttcatttagagcattaagctataaaaatatcagaagacatgtatttggttataggaagccacataagaatgagcagaagatttcaacagatcatttgttgggttagccaatctccagaaatctacagtgagctaactttagtgagcacagggcattgtaatctgagactgaggcgacacacactggatctaaggtgggtgagagaattgttagagacttgagagtgctacagtaacaactgatgaccttagaaaattggaaaaatatgacaaaaagatagacgtgtaggtatcctagagaagaggttaatgaatgaattagttccacacctcaaaaatgataatttataaccagctactgttgctgagactaaaacaagggagatagattaaacctcagtaggagggaaatagtttagatagaagaaaagataaccaggatcctgaacgttctcatgtactatggtgaaaaactgcaggagtatctgatcgttttccccaattctctttacttctagaaagccccagaatagaggagttgaggaactgatttttttccagaccataatcataatcacttattttatgttttaacactttgtctcccaaaggcatcctgagccatagctaagataacagacagtgcttgaaattttgagtgtaaataatttaacctagataaactggcatttaaatcttcatttctgcatttgtccctggctatttccccagctccactgtacagccaccttggggtagcagcccaaagagcctgtcagaactgggttgtaatgaaggctttgaaaggcgatagtgtagttgggaaggtggaaatgcctcatgcctaggggcaatctgagtcaaaagcagacagacaaatgggaggaggaggagggaggaaagaatgcttgagcaagtgaagagagaagggcatggcaacaggagcaggaataaaaagctctaaggcagggcacacaaagtgctgatagctgcagaatgaaggttaatctgatgttgaaagcaaaggggtttctcggggaagatagggacaagtgttctggtttcaatagtgaggtcagaagggtaagaatttgacatcggaggggttgctaccaggtggaaactagataacacaacagtgtgctggctgtggcttcagctacaggaataggggtgtcttctggattaatttttccttccaaagtttactgctcgtctctgccctgaataccttctgccctctattagatgctctcagctgtctttctctggtttgggctggcccctgtctcagttctatgctgagatagaactggtaactactgccttagttaccaagtttcttccttggtagtagcccctccacctctgtggtcctgctagcgttgcccagcgtggtcctttggcaccctggccactctgggttacagtagccgctcagcgtggcttcaacccactcctgaccctgcgccttcttcccagtatattcctgctctcactggttcaccaggttataacctacagcttggctctgacattcagtgccttcgaggttttaaggagtctaatattcaccatctgtagagacgggggaagcatgatgtggatgcctgctacatgggcaccatccctttgttgtgtacaagggtcaggcagggcagggtgctgacccagcctgagctgaggcctagagaaaagtttcagaacagtctagttgggaagaaatgcctttccagggcagaggaggaacttggagcagtaagtctgttagagaaaactggtaccgcagagaattaaggagcacagagccctgatttgagagtactggcaggcctgaattcaactttgagtgctactacatagtcgctcagaagttagtgacttgaaacaagctgcttagcctgtctggattccagtttccatgaaggaggaggaggaagaataagtgatagtgatgatgaagatcaacaacaacaacaaaaatccatttctgtagtctttactgtctgtacttggtactggtctgaggattttgtgagtgttaactcatttcatcttcacgactaccccgtgaaaatggcatcatgattattcccattctacagatgtggaaactaagatacaaagagattaggtaacttgtccacaattacacagctaacaaatagcaaagtcagaattgaagctcagcagcctggctccagacctcgtgttcctaatcacttggctcttttgtcacctggtagaaattacattgtgaaaagttgcttgtcagcagaggttaaggatcatttaagtttttaactataatattttatttcagcttaataacatagttgaaatgtgttgttttgtctgtgccactactttaccttgcccaaagtatacagggcccctggacacttccagaccacatgtgctctcactgcttggggacagctgttctaagataggcataatgtcatgggcacagcatgatactccttagctaatggtggactgtgaacatgattcaggctgaattgcctcttgcaaacaaaagaaatcaaggctatgtattgaaaagataggtagaaagaagcattatgtcttttggaatacataacatatgaggtaaatagtgtctggttctttgtacacttattcatataattatcaaaataaaccaatagatagtaagtagcacccttgttttgccaagagggaacctagaattcaaagaattactacccaagatcactcagtgtgaaagatgcacagacctagcattctagcccaggtctgtccacctccaaagcccatgccctagattgttcattttgctgccagcccgttggaaatagcctaaaattagtttaaattaggccagcaatattgagtttctttcataatcccttccaaccctgaaattccagttatatttctaacaggttcttaagaatagcatgctagccctctagttgaacacagtgggcccaggaacctcttttggggatgtcctgtgaagcttgagttggagacccctgatctgggcttggtccccacaccttcagctccttggtttgcgcaagggactgaattcagaggggatagtgtgatttatatctccaacccatgaaatgtgaagacaaaatactacattaatactgtaccctgtaaatcttttctcgcattagcagccttctggtagagtcgagttgccaaggaagcattgccatatgtgctgatggagctgaactaaaaggagaagattggaaaactaaccacactaataaatttcttttgaggcagttggaaaatggactgctgttttgacaagttagaaacaacacacacatccattctctgtttcaaatggttaaagtgaatttccaggacccaacagaaacatcttatattagaaacctgatttttctgctgaattacccagatgtcagatatatatgcactttagacttaattgtggttgtgatgaagtgcctcacctagactctctgctttaggcattactgggctgtgctacctctcctccctctgaggtcaaggtacaaggagggagtttggaattcccacctctttgacttttcattgtttcacagatcatgaccttcttacaaagaccatttacccaagactcatgttttcaaggcccacatctgtagtgggcctcagattataatccagtcaccttcattttcctgtttaaccagacaaggtagtcactacaagaatggttcttatcaacaacttccgtgagtggcagcatctggcctaggtcttaggaatggatttgtgctttggttttattctaagttgaagttaatcatttaatataaggaagctcggggcctctaatatattaccttaaactcctagtttctctagcttcctcaggtctctgctcttgcaaactatccttcacctgcctctagaactttttactttttgaactttactttttaccctaaaagccaccccatgcatctacagaatttggtgcatgctccttagtgggcctgggagagaagttgtgcagcgtaccaggtaagagcacaggctggagtcggacagcctgggtggaaccccgttcccccatcaaacagctgagccaccatgggcagctcccttaaagtcggcctcagtttcttcttcagttgctgtggataaaacaaaagccactgtttaagtaaggtattgtgtggattaaatgtgttcattcacataaaacacacagtactgtagtatgtggatatagcgagtgctccccaaatattggctgttgtcattatcactactattaataatattgttatttattatctggtcttctgtgatccaagcacagcctccagtgccctgactccatgccatagccttaagatgttggtgcctttgcacaccaactgtttcctctgcctgggtcaccttgccctccattctgctcattgtctcatctttccggggaacctctgctcacccttgaagtcccagggcaaatatctcctcttctttgatgttttttcccctcctgcaggcagaagaactggttctctccactgggttctcatagtcctgtgatgcccctggggtctggtatgcagcacctgctgttgttaggtggtttgtcccccatctggcaggtggagacaactagcgttccctttccctctaaactctgagcttcttagcggggaggcaccagtctcactgtgttcatcccagttcctctcagtaccaggcagacagagaaggcatttggtaaatgtttgctgaacaaatagctacttgttgccttctttgtagtcttaaatacggggttttcccttctgttttttgccgttcacaatgcattactaaatttatggtgagaaggataaatttcagtagtttgaaaggctggctgaagtgattgtatctaacacagtagtcattaggctctgtggcctgtttttttattagtcatttaaaaagactgtcacaggatagttatggagacaagagttcatcatttaaatcacagtgctttcaacccatccacaattttggtctacaatttaatgatgagaaaaatacatctagcaagtaaatgtttaactaagcattttgttacttgatgtgaatacagggagaaagatgaaaatttcaattgtgaagaggtagtttaaacaggcgtatgcccacatattactagtagaaattaatgttgtacttttattaggtaataaccaagccttctcctattatagatatcttactgaaagatcagtgagtgagtgtcatgagtatagtttaggagagaatgcttgctttggataagaatgcttgctttgcccaaatggttgcatattcccgttttttctcatatgctgcctcagctcatttaaattctaaagagcacagccccactcaagctagcaagagcttaggggggcttttgataaacattcacacaagagagaaagaaggtagaaatctcagatccaagagcaggagctgcactggaggctggcctcagtgggacccaaaggtgatggggacaggcgctcccacctgtgtgcctttcatgggctatgtgcattctctttttaatctctattccttttgctccacattctcatctgtccaccaatgcacttcctctgcttattcatggtttctgcttccttgtgatattagcacacacgtgacttccaattggctgctttccttgctccacccatgacatcttttcatcttgttgcttctgtgctaacttgtcccctcttctctaaagactgtcagtcatcctcctggagaaggcatcctaattggccagctctatttttggtagcaggctcaggttgctgaactcttgatttgcgtgtcttttaggtgttttacattgtccagtcagctgtggccctggggatgaagcaggcttagatgttatagttgcttagtgaagggctgcaaactcaggacaggtgagatggctcacacctgcaatcccaacattttggaaagcctaggcaggaggattgcttgaggccaggaatctgagactggtctgggcaacatagtgagggcttatctctttgttaaaaataaaaaatgagaaaaaacaaaaagaagcgttgcaaactcaaatgctgataggatctaggcaggttatataagtgaacaaatgcagctgggtgtgtgagatgcaggtacacatttgcacattaacacagagttgagttgtatataaagatacagattttttgagtaagatggctaaagcttgtatcccagtctcaccacttaacagctaggtaacttggaagaaattactttatctctctatgccttggtttcctctctgtagagtggttatgaagactaaatgagttaatacattttgtaaaatggtacctggcacgtaataaacgtgatgcacttttaaagaaaattttcattaacatcaccatccttatccttgtttaattccacaatgaaggacttcctcccatttttccatgaaaacatgaagctgtattcatctttttagttttccccctttataaggctatgagcaaagaaaaaattttatcaattgtgacgatatcagtaaagcaataaaaatagaaactggaggccgggcgctgtggctcacgcctgtaatcccgacactttggaaggccaaggcaggcggatcatgaggtcaggagatggagaccatgctggctaacatggtgaaaccccatctctactaaaaatacaaaaaattagccgggcgtggtggcaggcgcctatagtcccagctactcgggaggctgaggcaggagaatggcatgaacccaagaggcggagctggcagtgagccgagatcgcgccactgcactgtagcctgggcgacagagtgagactccgtcaaaaaaaaaaatacaaactggcgcttgtcctcattgaggtacgggcctcaaagcagggtgggcaccaccttgcatggtttctgtctgaaggatggagcctcatgcaatagagcagatggctgggatgtcagaaagaggcccggggtcagtcagagttcggtcagaactgagcccatgaactgactgttaggtcagtgtgttcattgatctttttttttttttgaggcagagtctcgctccattgccgggctggagtgcagtggtgcaatctcggctcactgcaacctccacctcctgggttcaagcaattctcctgtcttggcctcccaactagctgggactacaggtgcctgccaccacacccagctaatttttgtatttttagtagagacagggtttcaccttgttggtcaggctggtctcgaactcctgacctcagatgatccaccctcctcagcctcccaaagtgttgggattacaggcataagccaccgtgcctggcctcattgatctttcttacaaggaggtcagattatgtttgaaactttttgttactcaataaaacacacttataggttggatacatatggcattcaagctagtgacctctcaggctgctcctttaggaagagagtgtgggcagggctggtccctcagaagaggctgtgagtggactttcttacatagataaattagaaaattgtacttccaatgaagaatattaccatgaacctctctcagtatgacacagggtgcaacatgctcctaccttcagggttagcttggtgtgtgtttccaagaaaaaacaactgtgatttaatttttttttctttaagaagaacaaatgaaaatgatgacattttttagttcagatacgtagctccactaaatgttctaactgccttccccaaaattggtccttgttttagaaaatcaagtggtccactgatttagaaggcagaagggaaggagcagactttgggggaataatgagatttcctatatcactaatactgttgatttacccaatgtgcaaacgatccagaatgtgagatggaatgtacttgggactgatgcggctgttagaagttagtacttaaacattccatttcaaatattctcattaagggtaatagcagaaaattgcagcagagattaagcagtttttaagtggtaatcccctctgtagaactgttgatttgtttagttaatgctaatttatttaatatacttctactttttgttgatttttaggtctgttgccacagttattgggagttgccccagagaaggccataaaacttacagtaagtcttttgagttggtgcttcttattaagggattttgtacatactcaagaatctagcaggtattcttataggaaacagcaggtttgttttctcagaggtgctagctaatttgaaagcaggggaactcaccacacacattttttcattattctccatttagcagtggacatccaaaaatgtgataataaacttgaggacttttggtggttgctgccatcattgttgtcatcacagcagtagcagctaaattcccttcagtatctaccatattaggcacatgacgtatattacgttttactggtttaatctcaagcaaagcatgatccacagtttacggataaggaaactgaggcctatcgggcttaagtagcatacctgtgttcacacaaatcatgagtgggagaactagaatttaaaatcacacttgtctgactccagagcatgtctttctattacacctgctgtttttataggattcatggttagggtgtgttctataaagccaaatgtgcagggatctgggttctagttgaagttgatcctttatcagattatttgcccagtgcttggctcacatttgacagatggttgatattcagtttaagcgtttgtggaatatacaaatatttgcatcactaaggccacaaagccccagaaagtaaaactctagctttaggttgggctgcgtagctttggagcctgaaattcttcttttaccattttgttatgtgaccttgagatagctaatcttctctggcctatgtctgccaaaaagatatgactgtttcttaaaatttcttgtactacataccattttgagaatattatattaattaattaatgtaatttatgttctttgagaatccttgaggaatttttagatattgaatttcttctaagctgaaaaagtctgctcagccaaatttatctccatgatgagtactgttttagattaattcttgttagaagacttgaaagtgatttttaatcaagccttataaaacagttttaagttgtaagatgtatgtttttattttgtcactattgtcagtgtgtctcccttcttaagctattctaattgcagaacatatttttggctttcatttatcttttaacttttctcctgaaacatcagtgatgcatatatatttttcattttttaaaactattatactattaagagtacttctcaaactattttaagatctgttaaattgtgcaatttatgattactccaatagactgatagaaaaaaatagcatatattgacagatgcatatttataagtgtttaatgactttctttatatttttcatcagcttctataaatatttttcttcaaggtgaacgattttgtgagggataaatttatgcacaaagatggttcggtcccacttgcagcagaaattcttgctggaggctgcgtaagtaccttttgaagctctcttcattgaaaagacttgtttcacatatatatcactaccatggtcaacaggtgtggactaaggcttctgtttaaccacagatcctgcacaagggcagagtctactagggcacctcggcttttcctagacaggcgaaccattccagaggtggaagggtaaatgtttctgaccttactgcctgttaagtcatgcctgttaaattcgtcattgcttatggtttgttctgcaatggaagtcatttgtggcagaagtgtttggcctttgaaaaatctttgctaaccttttctaaagttaatttttagtacattctttcctcatggcaccctctgctgggtcaggcactaaaacttgtagtctgaagtcagcaaccgtagctctctgcttggctttgccttgcaagtggcagaactgttcaagcttccactgcttttgggagaacaatgctgggaaataactggctgagtgtgcgctgcattgtcaaaaatgcttggaatgattgtttccttatatggatgaacaacttgcatcttgttctgaagctcagcaaaacattgtgtctcgttttatctcgtactggtttgttcatgcgaatgtaaatactttaagtaaattaaactcttatacaaagactagtgttatttaaagataagattggttaaataacaggctttgatcactcaggcgatacaatattggttttttttatccgaacctatttcttataaaaaagatgaagtcacttttttaaattggcttactctgggcaggaagtagtattcctaaagtaatttttttcttgaagatccttgaatgtagacgttgggcaatgtttgtgtggaaagggcttattgtcctatctaatggtgaatgatggtttcttaaatgtagcaggacctaagaagtcctagctcctggtattctttagagatggatggaatttggctactgcctgactctctgtttgatcactgacctgttggagatgggcaggcaggatccccttgttctgtaactttaggagcgttcaggatggaaaaaaaggagcctttaatgtcctaaatataaagggcacacaataataatcaaagagaattttagaagttgctcttccccataactactctccatttaaaacaactctgtagtttccatttgagtaagtaggttttctaatttttgagtaggtatatccataggctgtgcctagcctagtccttcaggttgttgcagggcccaggatatagcagggttttttggtaggtcaggtggggttgttgtttttttaagttacattttaaactttctgaaaagatatgattatagatttctgtaagaattaaaatgtaaaattaattatgtgatactactcaagatgttggcaatcatcatggcatggtgcccagaggtttattttctttttaatgaaagcattttgcctgcacatacctctgggtgccaaggagattggttgtggcacgtattttctaggtgccatctgtaggtggtcttgtttttgcatatgcggccgcccatttcaaacacaaagcacattggcatcagaagtggtgcctagttatgtaaagagatgtagcccttttcaaacctgatctaaacacaggcttaaaattggagccacttaggctttacagctacttaaaatatctgtgaaatgaggtttgccatccttcatctcaaagaggtagacagtggtccttagcttttcaagtcttctcccttgcctttttcccccccaatcattactttaagaagtaagagtttattttcagttaagcaatcctgtaggtagcagacaacccaggtccctttagatctctgagtagatgaatggatggttccattttctgtgtgtgtgtttgtgtgtgtgcacacgtgctttttttttttttttttttttttttttttttcagacagagtttcgctctgtcaccaggctggagtgcagtggcgggatcttggctcactgcagcctccacctcccgggttcaagcgattctcctgcctcagcctcccgagtagctgggactacaggcacacaccaccatgtccagctaacttttttgcatttttagtagagactaggtttcaccatgttggccaggatggtctcaatctcctgacctcgtgatccgcctgccttggcctcccaaaatgctgggattacaggcatggggccaccccgcccagccatgcattttttaagtaatagcagcatctttctttgcaggctttggcaaagtcttctctataattggagtcagtcacacaccttagagggttgttgtgagttccacagcctcatctgtcctattgggaatacaaagggttttgtaaggttgtgtcacatgagcggttcctcatcttagttcatccaagcattgctaggtgttgacttttaagtccctggggagctcaccttgcttcatgattactgagaattagtacacatggctgacttttgcacttgtaaccaaagctgctcatttctttgaacaaggcttattctgttttatgatctgttttctgcaaaaatgaggaaagtatgtagggagatctttgtctcataacttcataatgtttagctaaacagcctgttttattgtatatatttttttagaatgaaagtgttagtaaatttggaggggaaaaaatgattgtcactaaaaaggaataaagtttatcccatttcttatttattatttttgatataataaagcctgtaactgaagagatgaaaaaataatcttctgtttcactgacatatgtaaaagggctaactttcacgtctaactttatttttaaactcattttttgcatttgagattagttttagtttagagcactgttaaaaattgacttcagttttctgagcatttttatagattcacactttaacagtagtgatatattcagcatgttttaagacaaaactcgatgctgagactggggtttacaaactctaaatctgaaagaatcctttgtggtttgtgttttctccctaacttgggtttctgcattctaaattagggttgtagttgtgggagttctgatggagacttggaccttcagtcttccctgcatgaggtatatatatatatgtataccttctgtttttttccatcttttcccttcttggatcaaaaacttggcacctttagagggatgtgattgaaaatctgtgttagtgaccgtgtgtgtcagaagacagaggttctgttaccactagccacttccagttaggttcccaatgattctgaaaattgatgtattacctctgaatatattgtttttattgcttttttgctgttactttaagaaaaaaataaaaaataatgtatgtaatgcaatatgatctgtaggctgcagtgcttcattcaacaaagtaagtgtatgacttttatatatctagtgtaatatgcatctaggttgaaatcttgaggagcctgggatctttagcttttgatcctttgatctttaaaaaaaagtcaccagataagaaatacaagtggtgcaatgactagtttcaaggaagaaatataaatatgatgattaatttatttggcctgaaaataaatctaatattactaagaaagaaagtcatgaaagtatgaacatctgtcttataaagccatatttagtaaaaactgtttatataacaagagaaagtaatagtattgtgtagtaatttttggaaagacaaattaacatgttttttaaactatggtcctttgataatgggtccagggtattttttcattgtgatgcacacatgtgtgtgcgtgagtgtgcatgttgtaaatataattggtgtttatagaagtttatattcattttgactgcattttgagttggaaaaacagtttatatgcttgtgtcactggttctaaaagggactggtgagactaacactgttgggaaaacatggaatgaagagtaatcttaattacactcccctataaataagtaggaccctaatgcagtttcctgcctgattcctaccataatggtgattcccatatgcatgatgtgtttatgccagtttgtccagccacgtatcaaatactgtttttaaggcaaggttttattactcatctcatacattacattcagttgcagttaatttatattttgaaaaattttgaaaaacacaacaatacagacacaggtgtgcctaccacttagattggtgacaaacttgacagtgcagttggaggcccttaatgtacctgtccaaattgcttttcattcccttacctctgtctcccaagagaaaactctgtcctgacagtggtgtttttcattctaagcatgtctctctactttttattacctgtgaatatcctaagcagtataaatgtttgtttttgaatgcctcatcctaacccagtgctctaggaacacctcatatgattcccagattgatgcctttgcattttttcccattagtgcaactcatgtgctttgcttatcagaaaataatagtaaatgggagtattacattcaaagtgttggaatgcggcagatactgcgtatgtctgttacagatgtgtgggtttctagatggacttatggttggaacagtgtattcatttaaccaagtttttggttacttggggtttctccctagacaacagtcatttcttcagtcttatgatttaaacttatacatgatacttagtttaaaaatgttaaccctccccactgccagcatacgctccctatctacctatcagcctgccttcccatcatccctcccttcttcttctgctgccatggttcttaccaccttcaaacattctgtataacttacttatttttcatgatttttgtttattttctgtctccttcatggtagagtacaagttctgcaaaagcagggatcttcttattcattgatgtatcctgaggactgcaggcattgcatggtaacctgtagactctttgtaaatattggttaaatgaaagaattttaaagctaaaatcactcaaaagtgatcttgtcaatcttcacagccaatcaacgacaaatctgataatggactcatttatatcttttctttaatgttagtcaaaccccttcccatcattaacaataaaacttatcacctgtctctccaagccatacttaatgataattcccaaatcaccaagaatagaaagcatatagatggagatcattttacaaagtgaaagtgttccttttaaaaccttgccattctaatttttgagaattgccaacagggatgctgctgcttcttttgtgtgtgtgtgtgtgtgtgtgtgtgtgtgtgtgtaaagttaatccttttgaaaatcatagccatttgtagtaaaaataatcacatctaacaagaggcagtccagtttcctgtaaagaacatgggcttttagtcggtttggggtcccaaggccttcacctgccagatgtgaatcaaggattagacaacttagttgacttctctgagttgcagctttcttgtctataaaatttagatagcaactttctctttcagttatctattgctgtgtaacaaacccctccaaaacttagtggtttaaaacaataatctgttctttttcattaatgctgcctcctttccgtggtttctgtctctttcccatggtttcagctggagtggtgaggcagctagaaggtccaaaatgtcctcacacaaatggcaatcagcttggagctcagctggagccatggctgggggaacaggttctccacatggcatatctgcgtgagcttcctcacactatagtgtcagacttaagaaggtgagttctgagagcagaataagaagctgagaaaaatctcaggcccagtttttgaggttatgcaacattaatttagccacagtgtgtttgttaaaacaggttataggccagccggattcagtgccagggaaaataatctacctctgaatgggagatgtggcattgatgttgcagccatctttaatgcaccacagttaccttgcctgattgtgggaaaaattaaatgagataatatgtatgaaagaattaaatcatgacttaagtactagtcttcctcctcttctggtgtctactttttaacttctaatatatatatatatggagagagagagaggatgttgtgaaaatgaatgttttagtttggctttttgggtgaaggggaatggaataggtgtattggagtttggatatggctgttgaggacctcagctacctcaggtgctcctgaaatctctggtcttctttgtgaacctgcttatttgccatttctctactgattgatttcctctgctgggtaacatagcatctttattctaaaaatgactttaatttcatcctgtgtccacagtgcatgccaatcccagttccaaggctttcctcctaacaggaatgatctcagtgtttctccatcattgaggaggagaagtgttctgattatctattgctgcataacaaataatctgaaaatttagtggcttcaaatagatacttattattattctctcttgtggttctatggattgacggggctcagcctgggagggttgtacttgggatccttatatggttatgggctagtggcagctggggccagactcatctgaagggtcaaccgggatagatatccaaggtggctcactcttgtaactgaacagctggggctgtgctccagagcacctgcttgacttctctgtgtagcttggtcttttcaaacattgacaatttgattctgagagggagcctcccaagagcaggcatcttaagagtcctgggcagaaacaagacttcttatgacctgaccttgaaggtcactgccagtgcattctgatggtcagacaagccagttaggctggcccagactcaacaggagagaaattagaccctacatcgtaataggaataatagcaaaggatgttttaactgccactggaggattcagtaagctgtgttgtgggctgggaacatcttcattgcccttcaccttgtgaaggtttcatagcccatctcatgccttctctgagggtctgttgctgatcctagaacccattcattctctagattgcttctggtagcagggggcagaaactcaccaaagttggagttaatcaaatgaaggtttactttaagggtacccattaaatgaaactgaaggctcttgagaattgaggcagcattaggaactggctactctctccattttctctacttggcctttgtctctctcacagtgactttgcatccctctgcacatcttttgactattctaatccataacttcttctcttcctgaagaattggtgttgactttctcaagaattcccttcatgttcttgccagccacctagcctttctctacagtaggagacagcctcttttcatcccttgccccagccccagctaattagcttaagttgttcagttttgttttgttttccatttaattattgagagaggaaatctgattggcaaacctcatctttgtgcgccaggccatacatatggcagccttgagtcatggcgccacccagatattaatgactttgcttaacatttccatttgtttcaactacctgtaagtgtcttcaaacctttcttgtactgttttgtttttagctctgaattctgtaagtttgccctgaatagtattgtgtatactttggtcataaaatatactcaaagtcaccattccttatgattgaacttgaaatcccttaagatttcatactcactcatatcaaaccaggaagaaaatttcctcatataatgaatacatatactctgacaatcagagctgatgagacagattgcctgaagtggatttaagtcttacttcgcgatctttttcttcccaggatttcctgtggatacgtagcctcatagtgtggttttcttaaggtagaatttttatttcactatgcaagtctctgcacatatcttacttataaatataagatgatgtgaggcttaatcattaggttgagtttttatgaagtcactcttgtgtgacatgtgaattaatcaagatacattatgcattatagtgatgctatagcaataatgttaatttttttaatgcttgtatctttacagtcttttgtagttcagtgaaaatctagtgattatattgttttcaaatgttattattgttattgtttggaatattccctgggagaactttttgcctactccgccaaaatgtaagaccatattaaagattttcttgatttgtacttgcactttatctctgccttccatctcctcttgacttggagggttggagactgtgtctggtattatatgacctgctgtctttgtcaaccatggtcactgctttgccacttgaggagatcttccttcataactttgtgctgacaactaattgcatctcacagaccttgagtaaatggctgaactgagacatctataaatatggatgacagggcctgtgttgcactgttacagctgtgtgtctagcattgtgtctgacatatggaagaaacttaaaaaaaaatctgttgaatgaataaatgcttgactacaaggtgtgggtcatagatttggaaaggaagggtagtgactctgtataccatgttactattcatttagagactgatggccagcaaagaggaattaactccaaaaattagtgggagagtaggggtgcaggaattgagggaatagctgtaaccatggctaggtgtctgcatatccaggatatttcacaagaaagtattccatgatcacccagtaatagaaccaacctttataaggctcctatttattttatttgacttcatttctaagaatgacaaataaataatccccaaatatattcagaatcttaagaacaggatgaagataaacaacttggagcatttggtatagcttatttattatggcttgtattttaagtagaaaagactttattgaatgactaacatgaaattatgtcagagtcatgaaggaatcatagaaaagaggagctttaaaaaaggaggagccaattaatagccaaaaaaaaaaaaaaaaatgctaacctcatggcactatctaaattggcagatttctgaaaagccaagaggcagctccatcggttttctcaaaaagtcctccaggcaatgggactaaggcattggtcttgaatagagttccactgcttgcctactccaatgagaggctctttctccagatgatttcaacttggactgagggcaaaattaaaagaaatatctgatggtactaagggctcatgggtgctatagattgaatgtttattttccccacaattgctatgtttaaacctaactcccagtgtggtggtattagaagagtgggacctttgggggtgattaggtcatgagggtggagcctacagtttgagattagtgcccttataaaagggatcccagggaggtccccactccttcctccatgtgaggacacagtgagaagacagcatctgtgagccaggaagcagtgctcaccagattccaactgtgccggcactgtgatctcagatttcgagcctccagaactctgagaaatgaatttatgttgtttataagccacgtagtctatgatactttgttacagaagcccgaacagactaagacagttaaggatagcctccctggctaagggctgccttcagtggctcagaaatgtcatcttattagaggaaagtccaactttcatgctagacactgggccagccagatacttcctttctgtttttctccctttaccttctctgggaaagtctcagagttgtttgactcaacacagttcaaatattgggccatctttctggatttctagtaaatagggaggagtttgttacgataggaaaatctgaagaaagactgggccatagctttcatacagttaaggtactttagacattgaaggtctgtaaatcattaaactattctggtagtagtagtcaaaatacacatgtataacaggcagaccccaaatgttaacatatttgacaggcctgtaagttaattgctttttaatgtcagtcaaatggattccactttggtttcttggccaggcttctatgggcccattaaaaccccatgaagctgaaaacatgaaacttaatatttgtaaaacatgtaaacagaatagcctttttctgccttaccgtgtggttaagaaattaggactaggatatttcagtttggtatctttctcagaatccaattagagtaagaatttattttattatcttttcaatattgttaataatctagtaacacatttttcacttaagagttttattttcataccaaatcaaaagaaaaaaaaattctatattgctttatgtttagagatgtgcatttggtcagacagtctaacttagtgtattcgtttggtcaggctgccataacaaaatgcctcataccacagagcgggaggcttaaacaacagagactggaagtccgaggttaaggtgttggcagttttggtttcttctgaggcctctcttcttttcttgcagatggccgccttctcactgtgtcctcacgtggtcacccctcagtccatgtgtcgtctgtgtcttaatctctaattataagggcaccagtcatattggattagggcccatccatttgacttcatttcttcttaattacctcttaaaaggccgtaagtccaaatccggtcacattctgaggtcctgagagttaggacttcagtatacaaattttggagagacgcaattcagccctaatgctagggtttaagaaaaggtctttctttcagtttgtgaggactcaggtttctgattgcaggagggtgatgatgtatcttgtgaaggcagtgagcccaacacacttcccttcagagctcgacagggtgagtggccttccgacctcatgccacctcatctttgccagcttctttgtgaggttgctgaatgccgtcttcagcacttgtgaacagttttgaacagcacttgactgcaatttggcaatgtgttttaatttattccatccactgctatttgctgaatatctcttttttacctgtgagctctgcatacaataatagttggttacatacaaattattttcatgtctctatttaacattgagttagtaagaaagtaaatggaaaatatgttgaaccttagattcctttacaagtctttattttctaatttattcaaatgtcaaacactgtcatcacttgtgtattcgtcttaatgaaacataaatcactagacatttattactatatatcttgtttgtagttacaattgtgtttgtgtccagataatcaaaataatgtatttgggtttaagtaaaagtctattctataactttatattaatctatttttgacacgtgtaagcacgcattttagaatgtcagtgtgcaattagatattcttagcacatgtcatttgtgaaaagcactttaaatctaagtacattcaattgagcataattaaaatatcaagatacatattcttcatatacattttgcctcttaattttttaagtagctataagtatctaccatgtgaattcaaattaaaggagggtgattaaattacagttatatttattgcttttagtttaaaatatagttgaaattgcgctatattaaaaaatatactgccatgttttctgtggacagcagactgatgatgggtttaatttgttttaatgcaagactattaatagtctctgaatattctcaagactgttgactagaatgattgggggttgggaggcgtaagaaggcttgtatttttatctaatgagttcttttgacttgactcctgaagtctcaagaaaatgttcaggaatactacctcatttaataaagaagcattggagaaagccttgttttgttgatacaaatgaaaggaaatggatcatggggaaatatgaactggagctcctgaacccttatcctttagataatgtatttaggctactgatatttcctatcattgtgaaaatgagcagacagccttggtgagtcagttttaaggcacatgtaactgttaaacctacttgtccacaactgttggacctaaagtatattatgattttagtgaaggccattgttcttggagtacttagagaaaatggggctgtacgttagaactctggattgtgttgcctttctaaaatatttgatttcttaaaattctgtttgtttgtttgtttgtttgtttgttttccaagatagaggcttgttctgtcgcccaggctggagtgcagtggtgtaatcttggctcactgtaacctccgcctcctgggttcaagcaattctgcctcagcctcccaagtggccaagactacaggcacgcaccaccatgcccagataatttttgtatttttagtagagagaggattttgccgtgtcagccaggctggtctccatttcctgacctcaagtgatccacttgcctcagcctcccaaagtgctgggattacaggtgtgagccacggcacccagcccttaaaaatctgtttttaaaaaataaatagctatatcacttccctgtgccaaaccagaagtgtcaacaatgaagtcattatgtaacatggcaagagggattcgggtggcaaaaccgtaaggaggagaagaagaaatcaagcttatagaagcatgtagacactgagtgaaagacgcagtgataggaaccacagtttggtttttttgcagactagcccatttcagagaaggcggtattagaagaaaaaacctataattttactgtgagccgtgaggaccatttcacatgaaaaaaaaacagagcatttggaaataatgatgcttcgtatcagtagaatgctgtgcgtttgagaagcttggcgcttggacttcatgctgacatggttgtagtcacagtcctattgccctttctggttgctctcagcactcctggatgcaaaggtgaatttatgaagatcatggacttccgatacaaattacagcagccaaaactgtcatatggagatgtgaacttaagattgtattggtagataggtgaagcacccattgctcctatcttgaaatgactatgctatatttagacaaaacctacatcagtataattattttgcaagcccatttgaagaaaattaaaactgtcactagttatatatttttgagcctaaaatatttctcacggctgggcatggtgtatcatgcctgtaatcccagcactttggtaggccgaggcaggtggatcacttgaggtcaggaatttgaaaccagcctggccaacatggtgaaacactgtctctactaaaaatacaaaaatttgggaggctgaggcgggcaggtcatgaggttaggagattgagaccatcgtggctaacacagtgaaaccccgtctctactaaaaacacaaaaaattagccaggcgcggtgacgggtgcctgtattcccagctacttgggaggctgaggcaggagaatgctgtgaacctgggaggcagagcttgcagtgagctaagatcatgccactgcactccagcctgggcgacagacggagattctgtctcaaaaaattggctgggcatggtggcgagcgcctgtagtcccaagtacttgggaggctgaggcacgagaatctcttgaacctgggaggcgaaggttacagtgagctgagtttgcactactgcactccagcctgggcgacagaacaagactctgtctccaaaataaataaataaataaaatatttctcaaggattcagatttggggattttactgccaagtagcctggctttctcattattgattaacctacaaagaaaaatttgatatatctgatgaaaatcagttatattgtacctacaaaaacatctcttccatattacttgatgtattttaatgtcactgaatccattggtttatctttatctcttagaagctcttaaagtcacaggaattctagtccatatgatcagattaaccaaaaattcaggcagctactccgttcaaacaggaaagaaaaaactgaaaatgaattgttgtattgaatctgctttttcacaagagacaactaggcgtaatggttctgagcgtgggttagaaattgggcaagtcgcgttcacattcttttactaccttgaagagaagtctctgcctccatctcatctctagaaagatgggaataatatagcttgtgtcagcatgattgggggattgaaggagatgatgtctgtgaagagtttagcacagtgcctcctacatcagaagtgcttgacacgtgtctggctcttgcttctccaggaaggagaggaggggagaagagagagtttgcagggccgtagttattcaagtagttacagctatctcttctttctggtcacactgctgggtaatttgttcttgaaaagtgtctcaagatgactgctcccacttagtagctggaaaatcacatccttccagaaagggatctagagggcagacatgggtgaagtgtacattgttagagggctgactggaaataatcagtgcagagatcactgtgggcagagccacagccttcaggtcctataaagggcagaacgataggaataatctactgcataggaaaaccaaagaaaagaaggaggacgaaaaacactctggggaggaaaaaataattggggttcactactgggatatctttccctctgctagaagatccttcatacataatgaatcacagtttggaaatggagcctttgaaaaaaaatccttacacaactggtaagagagaagtctcataccagccactgaatttttgcagaaatttgggcctccctccgcaagtgtactttcagactcaaattcctccagcatccaggacctcttgattaactatgtactctcaataaagagaaaaagatgagacctctgggaagcaagaattggtagaagctgggcctggtacagtggctcacacctgtcaccccagcactttgggaggccaaggtgggtggatcacttgaggccaggagtttgagaccagcctgggcaacatggcgaagcctatctctactaaaattacaaaaaaactagccaggtatggtggcgtacacctgtaatcccagctacagcaggaggctgaggcacgagaatcacttgaacccaggaggcggaggttacattgagccaagattgtgccactgcactccagcctgggtgacagagagagactctgtcttaaaaaaaaaaaaaagaaaaagatgctgaaatgtatcaaaaccagcctactcgtcatcctcttttaaaagaaaaagatgagtaaaccatcgcattactcattaggatgttaccagatatgtgagttggtcagagggactcctagctacaagtagaaggagtccactctaccattgactgtgtgcaaagtagcacattttatctacctttttaagatactcggccggatgcagtggctcacgcctgtaatcccagcactctggggggctgaggcaggcagatcacctgaggtcaggagttcaagaccatcctggccaacttagtgaaaccctgtctctgctaaaaatacaaaaattagccagatgtcgtggcacgcacctgtagtcccagctacttgggagactgaggcctgagaatcgcttgaacctgggagatggagtttgcagtgagccaagatcatgtcactacactccagcctgggtaagagagtgagactctgtcttaaaaaaaaaaaaaaaaaaaagacactcagtgactctgtgactctacgtatttggatctttccatttatctagtcttgtgctaaactttaaaaatttctgacactttataaaatgtgtgtaaatgtgtactgatataagatcctctacacgattttttattcagaatattcctgtcttcagacatcttcaggaaaccctgttggggttttgtttaggaggattgctttgaatttagattaacttaggaaaaagttataatatttgactgttataatcatttttaggaaaatttgcattttaaatttatagcccaagtgacgtatttgcaacattgaatctaatgatacttatttctctttcattcaaatgtttatgtgcctttaaaacaatacattttttcttcattttgatcctatatatttcatgttaagttattctttattaatgccacttgtaaaagaataaaaatatgtaagatttcttttggtgtaccagttctattgttctcctctaataaagatatataatgtttttgaatgtcgggtccccttttgaaaaatgctacaaaaagtttgtttacactggtgctagtattcaatactaatagagtgggcaataaaatgttcctcagttcctgataatagcctgggtgagagtacacatggcactgaacttagtaatttatcttctacagtcgtgggtgcacacagtgactcttaatagagaacccgctgtggtgctgcctgcagctctgggtcccctgcagccaggtgcaggtatgcagcccagtgcagatgtgcagccctaagccctgtttaaacacatggccacctgctgtaccttctaacctgttttgagttgaggaacagaatgtgtgagcctatgaactcacctctgtggtcatcagctgcttcatcttctcttctgtgttacagatcacagtaacttaatcataacttcctatggagagccagaatattattttactattgattctgaaggggtcttttgttgctgatgtggtttatgcatcagaactttagttgttcttgtgccaaattcgattctgtttgatttttttaaatctccaaagcataaatagtaaggacaactatgatttgtcagtttctgctctgtaacaaatttatcccccaactctgtatgtcactaaagcaaatgcaaactcttcatgttctacctttcactcctccattcagaacttgtactgttatgcgtaagcacagcataattatccctagtagttttatcttttcactctcttccccctagatattttctccttaattaccctaaatgaattgtcattgtctcttgattgctctcataaactactgtcattttctcactttcccttcccctgcaagtagactacacagctctctcattccccagcattctcgttccaatcctaggtcaccccatgtgctggactttgcctccctgtgtcagtagacattgttggtcctttcgccttctcacttctggaagccctgttcttaactcttgtgcctggattgctgtaccaccggtgtatagcagaggtttttcatcacttcatggtctctcgccactttccatttttcttcttcatcctcccaccttatctaaacccctgccttcagttatatatgtggagtgatgccctcatctgtgtctctcatccctcttaactcacccttccactgccttctgaatgtgtcattattcgtctttccaacactttgttcctattacacagcaaaaacttggatcctttctttgagcttacccactctttttgccctatattcagcagccaaatcctgttggtctctgttgcatccattacccagccacctctattcagtatagatatgactgttctaattctggccttttatcactcacctagtcggctaacaacctaattgtgatccctgcctcaggctctgcctcccggatgagccctctcccctctgctccctaggcatcttcccaaggcatagataatgctcagacctctacagctcctaagctgtgtttaccagctctcctgctgctacatagtcgcacagaccatctccagaatgcagcctgttctaggcagcatcctggaccttccatgagttggctccagcaatcttattttcagccaccttctttcataccccttctccatgccatctagagcaaaaggctgccatgataagaactgtaagtgtgccgctggcatccagccacttgagcttggaatccaaggttcaccttcctagctgcatgactccaagcatgttaaatagcctcctttactttttgtagcctcagtttcttcactgaaaccaggattttatttatttatttatttttattgagacggagtcttgctttgtcactcaggctggagtgcagtggcacaatcttggctcactgcaacctccgctgcccgggatcaagtgattctcctgcctcagcctcctgagtagctgggattacaggcacctgccaccatgtccggctaatttttttgtatttttagtagagatggggtttagccatgttggccagcctggtctcaaactcctgacctcaggtgatccacctgccttgacctcccaaagtgctgggattacaggcatgagtcactgcacccgacctattatttatcttattacttaccttataatattatgaagaccaaaaaacaatttttttttttttgagacagaatctccctctgtcgctcaggctggagtgcagtggcacgatcctggctcactgaaatctccgcctcccgagttcaagtgattcttctgcctcagcctcctgagtagctgggattacaggtgtgcgtcaccatgcccagctaattttgtgtatttagtagagatggagtttcaccatattagccaggcttatcctgaactcctgacctcaggtgatccacctgccttggtctcccaaagtgctgggattacaggtgtgagccaccacacctggcccaagaattcttatagaactcttaccacaatccctggtacttagtaagctagaggagcctcaataaatgctagaggatgatgatgttgatctcatcataattatcatccttattaaaatttcgcttggcagaagtgatgctgggtatattacccatataagtgtgatatgcccttgtcactgttcctttgtgcctttctctgcctggactaccaaaatcctaatcacactgtagtccccagctaacatgttaccttctcactggcttaatcacctcccagccaggagagctcttgccctcctttgaactgtcatatcagtttgtctggaccttggatcttatcatataattatctgttctcatgtcccattttctgtatttatgaggcatatagttactgaactccattgaaaatcctttcctctgcttgctggctatatagccctgggtacgttgctatattagtttgctagtgctaccaaaacaaaataccacaaactaggtggcttaaacaacagaaaatttatattctcacatttctagaatctgaaagttcaagatcaaggtgttggcagggttggtttcttctgaggtctctctctttggcttgtagatagccgctttttccctgtgtcttctcttttgtgtcctacatgtctgtgtctcagttttctcttcttgtaacaaaccagttggatgggattacgtcccaccctaaagacctctttttaacttaatttctcttttaaaggccctgtttccaactatagtcacattctgaaatatttgagagttaggacttcaactatgacttttggtagaacacagttcagcccataacagttgctttaatctttctgtgcttcaatttcctcttatgtaaaatctgcaaaaagtacctcttgagtggactgaaaatatgtaatatatgcaaagcaacaccttaataccccataatagatgtttaatgaatattcatgacttctacccttactacttcaagcttcttgagaatgagaataaagcatcttgtgtccttgcagttctaggacaaactttgaattgcttataaatatttggtgaatgaaaaatcaaatagcagaagtgagtctataataattgtatgcatttctctttctctcttagatggatccagatactagatgataactaagatttcaataacaaagagtataccaggaaacatgtagaaaagtcagtgttaccgctgtaaatataatatgccacactgagccagttcagtatggaatattttcccatgtcctacttgccacagactccagtaagtcatagggaaatgatttgtgacaaaattgcacacacacaaaaaaaacagtatcttcacacagccagagctttcaagtgatgagggacgcaaagacattgtgcacaataggtgttcctgtccattgtctgccgattcagctatctttgatctctgcaaaagaggaaccatgggtatggtactgtgaatgcataatagaccaggaattggaagagcggcacgcagtgtgctgctcagtgatcaagtcgtggagagacccagacaccatgcatctgatgataagcatcttctcttggtgccttggagtctctcatttccttccagttcgactccaaagggcctgtttcatcttcagcacctttacaatgtgccactttgagtctgtaggttctttctttcagaggccaccacagataatgggtacatcattatgttttcttgatatcactacattctttcttccccgtgcatctgcctcctgcagctctctgaagtggatttgactcctcatcatccctagtgataactaactctgctttaaaagaattgttatctgttggttggcttggagtcagggagttgagtgtaagttcttgttttattgtatataatgctagcaacttttaccagtgttagtaaagataagagataataagacaattccgtacctaagaattgtaccctttcataacagcaccacttggatatgtagaaagagtttgttgtgagatcagatgtaaaacaaataaaagttattcgtgaaatgatatggaagactgggattagaaactgtggcattcaagaagccagttaagctgattctcagaattgacagagattctagagatggtgtagtgcagatggtgtagtgcagggattctcagcctcactgcacatggtaatctcataggaaaattttagcaaggacagatgcagaaattcttattaaactgtcaggactgaagtccagaggtcactatattttaaaaaggtctgcaagtgattgtaacatgcatctatggaggaaaacatcagcgtaggagaaaaagggaaagaaaccaactggagtaaaggctctgtcttgagcactgtgctggctcctgtacattctccatctctttttatcttcatagtaagtgagatggtttgacaaatagggagaccgaagctctgccttcatgtgggacactcaactgcctccttccctgctgttggcagtgcttggatgaatatgcattgtatgcctcttctctcttccaagaagactggtttctctgattactttgcattttaccctggatagagatggtcttaccctcttttgagcttcaaaaaatcaggcttcaggctaattccaacctggtgaatctttctcagcaattctacccccataaaacaatctttacattttaaatttctattcatttttctaactattcataagattttcgtatgaagagttctggttcagaaacacagagaaaatccttaccgtgcctctcacatggttacttggttaggtgtgtttcaactcatcattctgccaaccgtaaatagctgagtccatatcacatgggaaatgtaggtgcaaattcacaaaacactcacgggctgtaaacaaccagggagttgttcttctcatggacctgcaggttgcagcagcagcatctgagcaaaacagagctgttctgagcagtagggcggggagcagcacgtctttgtgtggaccagaatgcaccagcctgtgggtgtatcatctcacactctacttcctagactaaggccctttcttgggcctttcagtgaatccaacccaggttggtattttgtgttgtcccccaacccaaacaaaaaattcatttgcacttaaggaagaacaagagtgacttgattaaggtatcaagttggtaaaaatggaaaaacaatttgatttagagagttaatgaacgaacatctttctttgattcttttcattaacattacacatattaggtaaactgtgtataggtgtttatttttctttatggaagtcacacatgatctatatagaaaaaatttcaaatacatcaaaaaaaaaaaaggaaaagaaagatacttgtaatcccaccacttcagaagcaccactttggtgtatttcttccacatggtggtaggggatggcagggggaaatgtgtaccagtattttaaacatatgagcatttttacttaaaagtatatattgaacatttttcactgttgactgcatagtatctccatgcatgaacatactcaagttcatttaacccatcccttaccattagatatttatgttgtttctaatttttctttccagcttttataaataatacttcaaaggccatccttgtagctagttctaattagtacagtatagtttggatgatataaaaatttcatatatgtgtgacaaggaataacaagttgaagtacagtaagaaagaatgtaattgcttgtgataaatataggcttagcttcaaaatagctagcttaaaatttcccttatagtgtactttaaagatttcactgatgatcttggaggtgaggcatctagccattgctggaatgaaataacacacgatgttcaaagtttggttggtaattgacttagtgcatatttttgctactttcatataccacttatctcatatgaaaagagcaattctgtacacaagtaatacataaacaaaaattttaagaatatgtaactccataaaatgagatttgatgattgacttgagtttctaagagaaaaaaataataactttcatctaagtttacgtgttcgctggcagtttttgaatcgttgccagaatcatgaaattcatcattcaagagcctttgtcctcctagtccccgttctgttctgtgtctcctcatttggatacgttctgtgtctcctcatttggatacgttctgtgtctcctcatttggatacgaatgcttttcattttattactgcctttgtgcccttggctttgagtcctgtggtggcagttgtttgtgcttcaaggagcatttgtaatttcagtgtgaggacttggggaggtcaacagaaatctctggtctttgccctccttcagcctccacattaaggacatagggcttcttcctaggcagtaactgtattttgattcatacttgtaatccctaaccgttttgattgatgggacaagggctgaaactacattctcttgaggatagaatatttttatccttgagaataatcattcatctcttcctgacccaccttaccatttctttgctttgatcctaaatcttttttgttctttttaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaaggtaacttttttttttttttagtcatttatttgattactttctcatctcctaatgcagaaactattcttcaacatgaaatccatttttttttgcatttctacacctggagaagatgttctacccaagctgcagaggcaccttcatgccaattagaaggaggtgccccttcctgccatctgccaaaaaactatcctcatcaatacacaaatctaggatgactatgataggaatcgtgccctctagagttgttcagtgcagctctttgcagcaacactggctagaattttatttggatttgttattgatacgctgagttcagttcaaggagaaacctgtatcataatttattttctgatcctatgcatatggtccgatccatgttttctctatatatgtatgccttgtcttaattattataaatcttaatcatttttcatttagaaaatgttttttcagaatgattacaaaaccaaacttctagatgattcttgaaattttttattcatactgctctaccaaaaagttataatggaatttactagaactgtctgcctatatgccaacctataaggctttatcaaacataatgtatacacaagttttcaatgaagaattttttaaaaaaacattttacgctagcttgactaagtaaacctttagggatatgggagaaaaataaaatgtctacttaagatagtttcatttatttacacagaaatgtatacagtcacattatataaaattaatactgctttgtttctataaacacatatcaagaaatattaaaattattcatgaattttgaatcagcatcttgagctccatttaacccactttttaggtcatctgttagcatggttttgcagaatacattgtcttcatttttatcccaagctttgtaatttgaagcatttttgacttttatgtatgatattgttcctgcaaattttatcccatagacacataatattaagacagtcaattgcttttttcctattcccagttaatcctgaatggatataactggtccccataatgtaacaacttaccatattgctagagtaaacttgaaatgacttgttttgacatttgacacagtatttgtgagatcctcctcccagaaatacttttttactctttttctttctaacctgagttttgcaagtgacctcagtaaacatccagaattagtaataattgtggctgtctcaggagaatctcccttccccgaatggtactctgcttctccaggtcaagtgattggaaagagtactccatgatctgagactttgtgaagattgaatataaagtgatgccctcttttctgggattaattttagcaggggaaaattttgccttatatttaggcatatgtggtacttaggaataaacctgctgtttttttaagtagaacttaaaatgctcaatctgtgattctacaatataacacaatgttctatagctattttgcttaccaatttattacccagctgtaaaaaataaacactgttgtcatgaggcatagcattgatcaatttgaagaaaaatcatcttttctaaatttttaggctcttgcagtctgtaatatgatgtagcagcatgtcattttgacaagatgccaggagtctttcaatgggttgtctggtaaaaagcacttaggtactgtggcagtgactgttattgaaatgtctagatgagtaaaatggtaggaacttgtttgctgatacagaaacagagactgttaaactacctgcaaatgatacaatactgggacttagtgcttttcatcttcacattatttaataatcttaatcccctttaacacttcttggaagtagttggtatcctggttttgtagttcaggtgaatagaggctgccaaccatggtatctgagctgaaattgaggctcagaagtttcttgtttccacttttgtgctaaaattgctttcctgaaatgagcaggattgctcaagtttgagcaagagaactctcccatatgaagttagtttaattactagtctagtagtttaatctagttcagaagcattccacagggcttggtgctcccttctaaaatgctgtttttggtgtactggtaattaccaagaaaatcagtaatgctttgagcttctggaaccttgattttgttgcaagaaagtgacctagtaatctctatcttcctgttggtcatcagtatcagctacattcagagacccgggagtcaggatttcattcagcagatgttgacctctgtggtttggtctcctttcagtctgattagctcttgtattacaagtctggttggtcctcatttatatattcccagcattctgtcttgggctttgtttcatgtgaacctctcttctccagccccaccccacttcacctttacgtggtcagacatcacagcaggttaagatccatctttctagggagcatcacagcattagcattgctttgtagtttaatgtgtttttgtttcaggatagcactttttagtaataaagcttttctgtttctagtcctggttggctagaaaaatgcaaatgactaggggtgacctcacacagtacttttaaacctggtatgtgtccctccaggtgggtctttaaaaagaagaaccactgtcctagatttagttgagacaggtaatctttctccttccctctgttcttttgtttctgttgttaacattacaatgccagacccaagaagggtgagtggttggctctgtctgtgtgtttaggcctgctgagctttaaccttacctaaattggaaaatcaggctttctgtttttcttctgtattgacttgcaaaataagcaaactattctgacttcccagtaagtggcaattagaatacttgttttagaaatacatttgcaactgaaaaaaagtggaaaatggtaaacattttgcattcctaaagtaagaaatagtttagcacaaatatagtaaacaatgtaaataaagcccccctctaaaatgctaacatttagagagatttagttatagcacagaggatgtaggtgactgaagtgaaggcagcataattaattgcctttgaaagagctatttgaatgtaatgtagctaagaaaacaaatctgcaatgtctacttctttttaaaaagaattatgagaatgtatttccctttccctgcataacttctgttttattgcataaacccctggagcataaaaataaaagtcaaataaacttaacatagcaaaaaaagttgtatccatctacttttgaacattaccttttccgtaggagctgtcagagcgttaatgaggggacaaattatactttaggaatggaatgaaacttatcatttaacagtaaatggcagcacagctaattaggccaaaaagacgcttcgttaggaagcagtggaactgtccatgtctctttttgagtacaaaacatggtcagtgaagcaatgacagctgggatccatcaagcactgttgaaaagttttcaaattctataatcacaaattaaaccttgattctaccttggagggtcacttaggaatatggactctgtctgctgtgttctaatcaaaggcgttgtttttttccactgcatttgacagtattcaaagatatttttatccatatacataaatgttgtatacatgtgttcatctataatgtgtgtataaatgattcattggagctattgttcataaactcagaaagcaagttatgatatatcagtacattcttatttattctgccagttatctcaaagagagattgatttttttagtttaaaaagtaaaatataatttatatttcaaaaaaatcaagtaatttagaaaggtgtatgaagaaaagtaaaattatctctctaccctttactgctccattctcttcaaaggatagccactgctgaagattttatattaatatatccttaaaaaaagaaaaactttctgctcagattagtatttctctttcaaaaattttacgaatatcagcatcagaaaagtatgtatgttttccatagcaaagacatagaatcaccctaggttaccattaacaggagattggataaggaaaatgtggaaactacacacaatggagtactagacaaccataaaaaagaactaaattatatcctttgcagcaacatggatgcagctgcaggccactatcctaagcaaatcaatgcagaaacagaaaaccagatatcacattttcacttgtaagttggagctgaaccttgggtacacatgagcacaaagacaccaacaggaggaagggaaagaggaaaggaggaaagggctgaaaagcttcctttcaggtactctgctcagtacctagctgacaggattaatagaagcccaagcctcagcatcatgcaatatatccttgtaacaaacctgtatgtgtaccccctgaatctaaaattaaaatgaaaggagaatattttacttttcttaagtaaaattgtgttttaacacaaatagaatcttttcaaacacaatatatcttaaagctctttcctcattttatttaataactatggaaatttttttgtttaactgtttgctgttgatgaatatgtttctagtttgaagatatatcaagcaatgccatggtgatcatccctatgtatattttgacatacttttgtgattgcttagaaaagataaattcctagcattgaagttgttaggtcaaaggacatgtgcactttttagtgttaatagattttatccagtttttttcagtttatcccttttttcttggtaacatataagtactcataagattaattcttcagtttatcatcttttaaaaacttgtatttttacgtgctcacagccggacctgaaggaagcagttgtttagtctactttgagaacacattgccattctagttttctgatacccagggacatgctgtggttttacaaccagcctagtggtagttctcacccatccatttctacttttatccttcatctgagcatctgtgaaagcctcttcagggctttctttattttgtctcttgactctcctaaatccactgttgccacagcagccaaagtgatccatttaaaatgtaaatcatattaattcactcactcaacacactcattgagagcttactgtgtgccaggcactgttccagcctttaggagatggctgtttaaagccaagtccctgctcacagtatattgggtaggacagggcagctatcaagagaacaaagatatggccgagcatggtgccttacgtctgtaatctcagtatttcaggaggccagggcaatctcttaatgccaggaattcaagactagcctaggcagcatagcaagacaccatccctccaaaaataaataaatataagttagcggggcatggtggtacacatctgtagtcccagctacttgggaggctgaggcaggagaatcacttgaacccaggagttcgaggctgcggtgagctatatgattgcaccaccacactctagccctagcaacagagtgagatgctgtgtctaaaaaaaaaaaaaaaaaagaaagaaaaaagaaaggaatgcgcaaaattaatatgacatcagctggtgctaccgtgaagaaaaagaagctgattttaaaaatgagcaaaggactagaatagatatttctccaaagaggacataccaatggccaacacgtatgtatgtgaaaaaaggatgtaaaaaattttcaacatcactaatcatcagggaaatgcaaatcataactacaatgagatagcacttcatacctgttaggatagctattagcaaaaaaaaaaaaaaacaaaagataagcaatggtgaggttgtggagaaattgaaatctttggtggtaggccaggcgcggtgcctgacgcctgtaatcccagcactgtgggagaccgatgcgggcagatcacgaggtcaggagatcaagaccatcctggctaacatggtgaaaccccatctctactaaaagtacaaaaaattagccgggtatggtggacgtgcctatagttccagctacttgggagactgaggcaggagaatcacttgaacccgggaggtggaggttgcagtgagctgagattgtgccactgcactccagcctgggtgacagagggagactccgtctcaaaaaaaaaaaaaaaaaaaaaaaaaggagatccttggtggtagaaatgtaaagtggtacagtctctgtggaaaacagtatggagttttctcaaaaagttaaaatagaactactatatgatccagcaatcccccttctgggtgtacatccaaaagaatggaaatcaggccgggcgcggtggctcacgcctgtaatcccagcactttgggaggccgaggcgggcggatcacgaggtcaggagatcgagaccatcccggctaaaacggtgaaaccccgtctctactaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaatggaaatcagatatctgaaggagatgactaccaggttcattgcaacattattacaatagacaagctatgaaataacccaaatgtctatcaacaaaggaatgcataaagaaaatatggtatattatagccttaaaaaggaaggatatcctgcttttgcaatgagatggataagtctggaagacattatattaagtgaaacaaggcagtcacagaacttcaaatactgcatgattctattcatatgaggtgtctaagtgtacatattcttgatgtatgagagagagtgactgagtcttttcacaaatataccaacatcaaaaattgaaataagtaaataaataaataaaaatgttgtgccttactcctgatggacttttattctctcatttaaggaaggatttttagaaatttaaggagagggtatcaagtatacctcaaggagtcaggttttgtatctaatatgtgtgaacatttgaaaaatactacaggtcatgtaatgtccataatctctgcttaaagcttgtattaaacaaaaactggaaaaaaaaagaacttttaaaaaataatttcaaattttattttacattggagggaacatgtgcgggtttgttgcacaggtatattgcatgatgctgggatttgggatatgaatgattcagttacccaggtagtgagcatagtacccaatacttagtttgaaaaaaaaatttttctttttacgaaacttcccctgtgcttcagatgaatcattgactcgtgtgtagaaagaggataataatcatacctacctattcatagtatcgttgtgtggatttactaaaataatgcatgtaaagcatacaggatagagttgagcacatagtacacatgatgtgttagttgttatcaacttttcattattgagtgtcaactaagggattcttgcaggaatacctagtttcttccacattattccagtcctgggtaatttccaatgctgtgtggtcaacaacctctccaggccaggtcttctgctttgaactttagaatagcaaattaaaaggagatggcttgaaaaatattatttttataaaacaatgcccagaggaattgagtgtgctaaagacaccagaaaaaaaggattccttaaagtaacagcaaatgatcaatttttttaaccattcttttattctttcaccaaatgtatattgaatgctaacactattagatgctagagtaccaaagatgtgtacagtatcattgccttaaaaatgatctatgttaaggggcaagagaagagaaacatataattctagtgccagcactttgggagtgcaggagttcaagaccagcctgggcaacatagtgagacctcatctctacacaaaaatatttttttaattagctagacatggtgtcatgcacctgtagtcccagctacttgggaggctgaggggggaagagcacttgagcccagggggtcaaggctgcagtgagccatgattgcaccactgcactctaacctaagtgatagagcaagactctgtttcaaaaaaaaaaaaaaagaaaaagaaaaaaatgcaacaaattgcaggtgtaggataattgaaaataatccagactagacacatcagaggaaaactgctgaacaccagagctagagagaagctctttagtggccagagaaaaaaagtcaatttgccttcaaaggggcaacagttgaactgacggctaacctaaaaatggcaacagtggaagccagaagacagttgaatggggtgtcttcagtatgtggaggaaaaaaacttttcaacctagacttgtataccctgtaaaaattgcttttaagaacaagggtaaagatattttttagactagcaaaactcagaaagtgtgtcaccagtagaaccttaatgaaggaaattctggaaggtgatcccaggtggagatgtgtcaggaatgaatagcaaaaaaagtggtaaatgtttagtcttgttaaaagtaaaacttcagccaaagtaagggagtttaattgtacaatgaatgattcgtgaatcaggcagcccccagaatcacagcagagagtgctgaggcgggcagatcacaaggtcaaaaggtcaggaccatcctggccaacatgttgaaaccccatctctactaaaaatacaaaaatttgctgggcatggtggcgcacgcctgtagtcccagctacttgggaggctgagacaggagaattgcttgaaccagaggtggaggttgcagtgagccaagattgcaccactgcactccagcactgtctcaaaaaataataataataaagaaataaagaaaaggtggaacatgttttacagatgagctttgtgaaggtgacatgactagcagcttcaggactaaaattccatgtgataacattcctctgtaccatgtctaggattttcagtccatctcagtgatgagcattgttgatggcaaagcagtgtacaatactagaacaatagagaactagcactgacccaagcagcatttcctacaagaaacagagttgtcaagatgattttgttagaattgcaatgaaattaaggagaacccatatccctaaagtccctggattaaagaagccaagtaatagtcattcatatttcatattcaaattgaagtaatttccatgttcactgatatcaagtcttcaaatgttggctggcttatttggttttaacacaagtgacacaatcacataataggtcttggcaccattgctatttctcagcaagacactcaaactcaccctcctcaaatctcagccatgtaggtggggtctaaccatcctttgactgggctggagaggcactgccaagctgtgtatctaagggttaacttgcttgggggaagccaagaggaatgctaagggatcaagtcatgacatgctgcccattgtttgtagctctgggatcaaaatatataattatacatgccaaataaattctaaacctgtaaggtaggaaaagagggctgggtggctctgacgacaggtgccagaagcattgaataaccttctcagacaaggtgcaccactgttgtcttgaatgctgcagggtccccagtctggcattttccccgtgctagacaatgtgcattcactgctggagtctctgttaagcctccgtctcccagacctgctggctcctggtgcccggcccgacacagaggtgcctttgtgagtgtaattacctttccctgtattagaaatagtctgtttagagctgtgtttgcaggtacagctagaataagcaggaattagcatgcaaaaagacctgccctggccctgacttctttatcagcaccatccttcaggactggttttttccccactttggattgattgggcaggtgatttaccatccaagatgaagagttttaaaagaagaaaaagagacatcggaaattgctgtgcatgtgcaacagcatgcgtgcgagagaaagagagatacaaatcctgttgtgttatatctattgacagtttcataccaggcagagctggcaaaataaacttgagtggacgatcctagcaacttgagaattgattaaagcttccttgggctttcagcacagtgtccacatcaaaaaggcatgagaagcaaaataaatgattcttttgccatgatatgctgccgccagaatctctaagcctatctaattggcctgtgtcaattgtggactattaatttgaagttaagtgaggcctacccttaaagaagcttttctagatcttaaataggatgatgatggagagactttggcatgatatagaattggaatggaggcagagttgataattaaactagatctgagggttttttcccagtttataacgtaggtctaccctgagatgatttttgttgtccctgtctggatattagtgtgccttttatttaaaaagaaaaacccaatagtttatcatctttagagagattagatgattgtattttgcatttattaattttccccaactgattatagtatatactgaggaaattcaggaccaatcagagaatgtttaagggcagagctgcctagaaaaccagtttaaaaaaaaaaaaaaaaaaaaccaaagcaggaaaatgtggggattttcttatatggcaggaatgtttaaatatttttttttaagtggcacacctttgtaacttattaattctcaaatggccaaagtaatatttttgtgttgctgatgcaggctctagggcagcatggaatgtttccctttgttataaagttgccttttcagaatggctgatctcttggtaaaaattatacatggaacaagtagaattcaagtcaaacaggtttatgttttgctgtagtactggagaatgggtgttcaccacaaagtgaaggatttatcaaggaatctgggagagaaacattttcccccttagaactttaagtctttttaacatcctgcttcccttttcattgtgcaagagcaacaggtcaggtattgcctaaggcagtcttacaaattggcacctgcctttatgcctaagacctaaaggaagtggtggggaaaaagaggccagggaaatttaataagtctctgtctttccttgggaattgggctttgatgcctggggtgcaagagaggtgaagggccgcctcctgacgcaactgggagaggtattttctgcagggagacaccagagaaggtgctaggagaggcagggagacacagccctcaggtgaacacatttgtgtcctttaatgtttgtaatgcagtggataccttacaaggactttcacacatattacttcattcattcctaaagtttcagttgtcccagtcacctgaagaagatggcctttggtatttttgacaggtgaggaagcttaagagcttgatttctacaggtgctcatcacatggctaggggtgacaggatgatcacaccaggtggaagttcttttgcttccttgacttttccatttcttcctttttctcaggtaatcagacaccaaagacttcttgcatatcctaacatttgttctagtctgcataaacactttgaccacattgcttgattcctggaaaacgaaatacaacccatttctaggcatttttcctttagtgttgcaattctaccctttcctcagggttatatatatatatatatataaaattgtttgtatgtttggtttttaatcaagccatttctcatctcagccatgtagagttgttttccagcatctcttgaagtacatctcacatctcttgtagatgccattgtaacagggatacatgatttactgtcatgatttcaggaaaggaagaagaaggaggttctcagaaggtggaacactcagtgggtccttcttcagaagacccaactgattcttcatgtgcctttactcttcctgtgcctcagggatgtttataatttcgagtcatgtcttcccatggccttctgatcatactgaagccacatagcataagacaggttaatctgcttctctttctcccctcgccccctttttttaaactttaatgtttcaatacaaaattagtgactgtttcctcctacgttttgttacattcccaacaaataatatgtctttgtttgaaaagctaaaagtggccaggcgcagtggctcaatgcctgtaatcccagcactttgggaggccaaggtgggtggatcacctgagatcaggagttggagaccagcctgcccaacgtggtgaaaccccgtctctactaaaaatacaaaaaactagctgggcgtggtggcaggcacctgtagtcccagctactcaggaggccaggaggctgaagtaacagaatcgtgaacccgggaggtggaggttgcagtgagctgagatcatgccactgcattccagcctgggcaacctgggcaacaaagtgaaactccatatcaaaaaaaaaaaacaacaaatgaaagaaaagctaaaagcttggttttagtttctgatatgtttttccaagaaataatgttttttaatttttattttttatttatttatgttttttattaagatggagtcttactctgttgccctggctggaatgcagtggcatgatctcagctcactacaacctccacctccgggttcaagcgattcttctgcctcagtctcccgagtagctgggattaaagtgatcttcatttgagttgattatttgatgtctaatttgagtatcttctggactgaatctacatgtggatgaatagctagcagcacttacaagaaggcttggggcaaaaagggaaaaggaaggaaaaacagaaactaaacgctgatattgttagccttatacaataacagcccgaattataactttttaaaaaactagttgtaagaaaaggattggatgttacacacagttattaacattatactgtatgttttccctttgaaagagctgggagaagtggaaaaaactcttagagtattgagttttggacttgtctctggaactacctccagggtgccctctgaacaagccaagggcatagccctcggtaaatgcacaattgatagattacccatccaggacgatagattacctgtccaggacgttagtttgtacgtgcctaaaatgactagcttgggtgtggtggatattgtgattcttaattagacatctaacactttgggggtggacaagatacagaagcctgagccggttggcagtacatgaggtagatgagtgcttctctgaatacctgtatacacagagtgaacagaggcatgcttacacatccatgggtaagttgactgaggaagagccaacatgacagaatccagattccaagcatttgttctggttggcaggatgagccaaactaggatgcaacttaataggattaaatctgatgtcctgcctgtgttacttgtgtgaggcaactaattaagttatagtagacttgagttaatagtaattcatatgaaaaagactaagggttttattacccacaagctcagtttgagtcaggagtgaaatgtgcgtgtcaggaaaacaaaggctatagtaacagatacatagtgttaaataactttgacagtttggagcatcagacagaaatacccaagatccagcattactaggcctcaataagtgtcactgggtgtggctagatctgttgactctggctggattcattattttcttttgggaatctctgtatttggtggaaatttttagttattagaaatctgttaaagaaatggtattaaatcattacatgttgaaaagtgatgatttccttcctattcaccctacccaaaacacaatatatgtgttgtggttttcatcataatatatcatatttctgggcactcatcaattcgcggggcctctgcatggcattatgttggcaacagaaactatttgttgaagactttgctgtaggaactgattgttctacacacagctttaaaatgtatccgaattattgtgaatatttcaggctttagagcaggcatttatcaatgtttcataaaccctgggtggcaggtaagtaagtatataataaaattagaaggatccatgaaccccctgaaaagatataattttttatgtatgtgtaatttctttctgggaaacagtccaaacgtacaaaaagcaaaccccttttccccccacctgtataatttgtctacttcctagtgtgtaaacaaagaggcatcttgactgccgttacccgtctttggtgagaccagagaacagatcttccttgaaatgccagtggcttgccaccagtagggatttaaaaggatgtcacaggcagagttccaaaaaggttttaattgaagtcttagcattagaataaatgagaactgccctcctcccatcacagcacacaacaaaactagtttttgttttaaaaacaaagtttagatttattacttgcagaatttgggttatttttttctgttcccctttcaatgtgtgagtacaaatttggtcttctccaggaatattttgttctgaggtgagttccagagaagcttgatctcctcaatgggatatgtgtttcatgtggtttttcttcctttgcaaatgtgcagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtgagtgtcccccatggagttctcttacttccctgacccttgctgccccccttccctagctgcatgctactacattgaaatttttttgctgatagttcttgacagggtatgtgtgagtttgctagagattgaagagctactgaaaaaaaagggaaaaaattaatcttcattctggcagatgagattattagacaagcttaatttcttaactctagaaaaggctcattaaatattggcttattttgtggtattgtggaactccaattcaagttccatatcatttcatagtctcacttcacagcataagaataactgtttagctggaagtttttaaagatttgaataggtttgtcttaaagatgtctaaaaaaaatagtgcataaaagcctgtccagaacttaaacaatagttagagaaaagaaatgtagtagaaccagaaaagacctgggccaattagagacacctgtttcctccctgtgttacggggggatggtggtaattaaatcacagatggaaataactatcttctttttttcagtgctccattgaaaacatcgatagaaaataattaaccatgccagggatcagttcattttttgatgctgcttcttttcaagggtccctaagagcaggaacagtctggattagctctccaagtggtgacatttaataagttaacaaaccctaaggcggtcacaggatgcctggatccaaacatttttgatacctgtgctattctcatcagatatgtaactagagtctccatgcttttctcaaagatagcataagaacaactcccagctttgagaagttgtttgctgttttgtgcacaccccacctaccctggctgcagcctggggaacccctggatgcaggaacctgtgtagctcctccttaattcttagttaatccttttccttcaaaggcagtgatattggtatataaggcagggctactgtttcctggctgcttagaaacctcagttgtattagcagcagtgataccactgtatctagagcaagagatcatgatttcaggagttgagtataaaattcccaattttaattccagcttgactcatggtggcctatatgtaatttctcatatatctgtaaatgagaaaatgttttgaaccaaagggttataatttatttcaaattatttacttgaaataaggtaggacctaatgagaataactgagtaccacttattaatgtgtgaccttgggcaagttacttcacttcttgtaagctttggtttcctcagctataaatggagatcacaactgcacctgctacagagtgtgtgtgaggctcaaatgagaggatccatgtgaaagacttggcatagttcttagcatacagtaaatgctcaataaacattagccaagtattacattgaatccaaaagaatctgtctgtaaatcactccaaaaaataagttgtgaaattagaagttaagtagtagagctcagatcaaggtctaggactctttcctaagcctcactttcctcacaccataaaaataccatctttaactcttttcttggagaagacaggtacccagaaacgattctgtctctgtggaggtaatccattctaccagagctatagaaatgactggtgagattttttttcatttaaggtttatttttctccttttttaaatgattttgaaactaatattactcattataaaatatttgaaaagtactagaacaggcaaataacaaaaatattattcattatttcactactctaagataattgctatttaacatttttactcatttttcctattcaggtttttcacagagctgtaatcacactttgtatagatagttttcacttaaggttgtgtcttaagcattgttacccatcatggcaaagtagttaatgacatgtgcctgtggggtcagactaccaatgttcaaattccagtgtttccaccctgtgtgaaccacacacattattcattccctctctgccatttctccatctgtatttggagataagaatagtcttaccttacaagattattatgagaattaagtgaattaatagatgaaaagattaaaatagtgcctgatatatagtaagtattcaaaaatgttccataatagtaattttattacatattatttaaaactttccgaacatagtttctaattgctgcatcttatgtatttctcaattttagatactttaattttttccaaaaaattttaaatagctagtagtatgctttttcccctatgttgaatcagttatttttttttaagagaaatagattatctgaagtgagtttgttggtaaaaagcatggttgtttttcggtcattgacccattattcttgagagttttaagtagttggcatccctgtggtgatgttagttcagccctcttgccatcctgttgtctttataaatgccttctgtatttgttatctattactgcatgccaaattccctcaaaacttaatcagcttaacacaactaatatttattttctcacagtttctgtgagtcaggaaacaggtgtggggtagaagcagctcactgggtgcctctggcaccaggtctatcatgaagttgcagtcacagtagcagccaggcttgactgacattggagaagccactttcaagatggctcaatgacatagctgttgacaggaggcctcagttccttgtcatgtgggcctctccattggtcaacttggataccctcacaacatggcagtagattccccagagcaaagtctgagagagagagagagagagagagagagagagagagagagagagcaagcaaggcagaagctgcagtgtcttctatgacttcacctcaagatgatagagaagcagaggcgtgaatgtcacaagggtgcagatctttgagggccattttgggaactggctgcctcacttactatagagcattgacttttattattattattattattattattattattattattattattatactttaagttctgggatacatgtgcagaatgcgcaggtttgttacatagttatacaagtgccatggtggtttgctgcacccatcaagccatcatctaggttttaagccccgcatgcattaggtatttgtcctaaagagcattgactttcctattattatccaccttcctcctgatcccccgtttctggtaaaatgggaaaataccgagtttgccctgttgattttagtcttcaaagagtgaataagctacaaagcttgatggtctttgtgtattctacaaaactataaaaactgtgtaatgcgaagtaagctactttcttaatttaataacagatatcagaagccagtggtcaatgtcatagttaccattccaattaaagttaggaataagacaaggatgtctctctcatctttgttattcagccatattttggaggttccagtcagcatggtaaaataaagtaaaaggcataaataaaagaagaaaggaagcagtcattatttataaatgattatttacctgaaaatcaaaattaaaatgtctaagaagtatattagaattaggaaaaaagattagtaatgcattttgttataaaataaacataaaaaatctatatccagtgagcaggagtgatgtcatggggtgagcagggctgagtgtggaaccttgctgagatgctcaggcagagctgagttcagtgtggagaagggcaagacttttgtcagaagtgtgccccgtgcaaccccaagaagggcagtgagcaagcacaaatgtgcactaatcctgaatgggctgttgggtggaggacggatcaggcccccacattccctttgtggttgccaagaagagcaaaggcatttcttagggagaggatacatggtattcagagaatcccagaaagtatttaataggagaaaagcttctttcaaaatacaaaaatcctcctttttagatggagtttcaggcaactacaatgaataattgttggcctctaacttataaaacaaaaatgtctcatggctatttttatatgtaccatatttaaattgatcacttatacataaaatattttttgctgaacatcagcctattataaataatatggacctgtgattaaatgaatatgaccacgctttctatgtttagataataatttcaattattcagtaatgttatctcactgttttctttccaaaaatttgattagccttgaggttagattgttttagtaatatgtagctttttagcaaaagtggttattggtatcctcacctagagaatgttgggttttggtgtttttgtttttgttttgttcatgtatctagttataaactgggactatatttaaatactggaacatctactccgttatttcacaagatagaacaagactaaccaatatttgaattcatgttcattggccaaagtacatcagctttgtcagaaagtgaagaccgaagcgggggtcctgaaattaagaaatcaaattctaattatctataattaacatggtgctttatcattaatgaagggcatttcaatacaccttgtgaatgatatcaaataaaatatatctaatactcaaattttatagaatgctctatcataccagatgatttttatcagagtgataagatagaggaacaagtcaaactgtaatgatggtctcacctttgaattaattagcttgagattaagttgtaatacagaaatacctttaaaagctgttccagtacacagaagtggaagtgtgttatacatgtgtgatcatgatgcttttgcaaacattagattgtgtattatgagaaaactactgttggtacaaatttgttaattatgtggacataaagcttaagttataatagtttaaaaccagtccttaaacccttaaaaaaagtaatgaagaaattgaatcaagacaatagactgagcatattcatccatctctcctgtcttcccaaataccttaaaatgtcaggaaatgcatttttaaaaaattctttattggcactagaaaatgctaatctggccctcagcagaaaggaaatagccatattgactctgaaactggactgagagatgccccagtccaaaacacagcaggagaaactacctctaatgcaagggctgaactggagaatgttaacctttgagtgaagaatagaatgcctggggtggaggtggaggttttagggtaaatcattaacatgagttaggcaactatactttcttcaggattgccaggcttggagctctctcctggttttcatatggagcttcaggagacagttgtatccaagttaaaagctcagagctcaattttaaagaaagagaccacttccctagagaggataagtgtaaggaatggacagaaagtagggcaggacttaaggtaattcaagacttctaccacagatgcaggaaaaaataaagtgatggcagcttttcccaagaagaattaaggatttaaaataaattcttctacccccaaagtgaagttccctacatttcagcagttcggagggtccacaccctgccagcatatcctaaccccttgcacccagttacacaaagcccatagaccctcccattcaggagagagacctgtgggtgaagcatacctagaatatggtagaagtcacccacaacatttgtatataatactaatcagcctatcctttgaacttgaataatatcaatagacaaccagagatccccagccatgaaggagcaacaaagtaagtgaacagaagaattagagagaaaacaggcaattcaggggacagaagacaacttttaagaactataattaattaatataattaattagagtcctcagagagatttgaaagaaataatcagtaaagaagctttcttgaaaagtaatagaagaactgccataattaaatatcaagcgttagttctgaatgatataatggatatgatcaaagaccaaatttagacatgtggaaaataaagacatgcaaaaaaaaaaaaacccctctagaatgtaatgtgtagcaataatatagagatagaaaaggagagaaaatttaagatacaggtagaattaatcttggaaatctaacatctgtttcataggagttccctagggaaaagtaataaggaaaaggagaatagaaaatgaatcaatagaagattgacttctcatcttcttatctgtaatactggatactttcaaaatcccaaggaaaggatgtcttgagtcgtaattatgttcctgggcacactaacactcaggagggggaaggcaaaactaaagttagtttttcacatgcaaggactcaaagctttcttccccacagaccttctctgaagcaattaaaaagtgaatttaagggcccagcacagtagctcatgcctgtaattccagcactttgggaggccaaggtgggcggattacctgaggtcaggagttcgagaccagcctggtcaacatggtgaaaccctgtctctactactaaaaatacaaaaaatagccgggcgtgctggtgcacacctgtaatcccagctactcaggaggctgaggcaggagaatcacttgagcctgggaggcggaggttgcagtgagccaagatcgtgcgcagccccagcctgggcatcaagagcaaaactcagtctcaaaaaaaaaaagtgaattaagaaggaggaaaatgtaggatatatgaaacagcaaatagaagttaaacctgtggtaggtctccattattgctgactttggtatatgtattcatgcaagaatggttggtttttgggagactgacaaatgaaaggaaggacaaaagtgccagtgcgccaaagtcctccccttgctggaggatgcaaatgctaattaattgcacctgttgtaaatgtacacctatataacaaatgcatgtaacgtttaaatatatttagtcagggaagtggtggggatcaaaagggaaataactggaagcagagaaaatagcataatataggatggcagaaataagtctagtagtcacaagcactgtaaatgaattcagtacccctagtaataacaaacactttaagatgagttttgaaagaaaatctagtcatatgaagtttcataaaacagtgacatagaaagattgaaagacagctgattgaaaaatatgtaccaggcaaatatcaacaataagcaagtagcaatattaatgccatactgaatggaattcaaggttttaaatagcgttcagaagcacacaggcatattttataaaagataaaattcactatgaagacgccatcaatttctatgtaatatcaatgtataatgtcatctctcagcttcaaagtatgaagaaaatgcgatattttctcatacctgatgaaaaactttatcacactgcttttagaagctgacgtattaagtagataatatagatagagatgcaaaggggatttggaaaacagccttgatccaaaataaatagatattaacctttgtattcaataaaaagaaaagcactttccttataaatataaatgggatatttataaaaattaacgatgacttgtgccctaaagctgtattttgccagtcatgttttctttttgttgtaaattatattctactctagctgggccccctttgaagacttgtaattttttaattggttgagacatgccccaagttactcctgtcacagaggtggtggatggcccctgggtctctgtgtttgtcttgtcattgaagaatcaggcagcctgccagtccctttcctgctgagggacctagaggaagcatctctgtttcccagtctcctcttgctcccctgtctttaggaatagagaaaattcagaccacttgatcagcattggcttagccttttggaatccagaagagagcaggcagatctaccagacgtccctgccaaccctggcccccaaaatcaacagctctctggtggccaagttcttgccagtatctgctgctttcccagccttgctttagggcagcctggtgcagttctccaggttaacttagcaaatcctcacactggaaatctcctgtccaccaagatgtccaaaattccttttaggccttaccagatacctgcctaggagaaactggagctgacaatggagatgatgggagttatgttcaagttgccatattctagcattcgccacaactcctatcagttttgccaggcaacttactaggtgtctttcatacctgcttccttcacccccagtacctctattttcataacaaagaagagtttatgaaaattaccctagccaaagggaactttttgcccattttattgcttgtatgtctttcacagtcacagtctgacatgcctgcccaccattgcaaggcggcttttattgcatgtctaaagcaggctgtcttgctaaactctttctaaaccaggaagtaaaacaaaatcggtggtgtgaacacagtgggtttctaagcatttttcttgtttccttccattatgttggaggataaattcctggcccaaagttaaaataattcctacaaatgaacaggaatttcagtatgacttatccagtgaagcactggatataaagtgagctttttgcatgcagaattgtgatgtattttataaaacctcttgagattaatgtttgaggagctaggtaaagatggaagagatactccttcagtaatataaatggaagcgtgtagtatgcagatttacaccccccttccaactcactgtaactttaaagctgtctgttagaaggatgaaatgtagttgtgagccagaccatgttggtttggacagaaattcttacagaattattaagccttaaaaaaagcaaaggagatttatgcatctgcatttgaccaatttggtttggaataagttcataatggaaaagtaataaaaccataagagacagtgtcttctgagtacagtctcgcttttaaaaaatctaaacatgcactgccctattttggatacagtgactgtagaaaaatttcccattggtaactttgggagggttttctgttgttgttgttgttcctttttcattgattatcagccagtataaattttaagctttctgtcaaatatttttctggagatgtcagtcttagggaaaagaaatcctaaagtgttatctgtaggagtctccttctcccaatttcaccccctccccgaaacctccacctcccaccccccaacacacatagtgttttttagatatcagtaaagtctttttctggtgtaactggagaggttggggtttggagagtagggggtggttgaatgtgtgagagaaagcacctcctgtgactgccagcagccacagaagaccatgaagaggaaacgcataacaagcttcacctctgaaaaatcggacctaataacttcgcaagtttttgatttcaacaggaaagaaaaagaaaagaaaaccgctttctccacttattctcaaccacttgaagtagtgttattgataaacaatttcttaaaaatatttaaagatttaggaatagaaacaaaggaaatgaaggctgagtgatttgggcaagggaaggtgtgagtctggtggggaggggtgtaggagcagacatcttgcacacaggagaggcatggttgcatttcccatagaggacagcaaaataggcattttattgaatcggatttttaactttctttccacggccagcagttcaaagcacagttatttttatatagtgagaatgtgaccagactgagatggtgttgtgtctctcctgcaggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtggtatggaaataatgtgttcttaactaactctttggtatcaggtaaatttttaaaatatctaattatatctgtgatttctccatttttttaaagctcgtgtatttcgatcctcaccccagtttggtgtaactttgctgacttacgaattgctacagcgatggttctacattgattttggaggagtgtaagtatcatgctaaatctgctgctaaattttggctgctgctaatgctctgttgtcgtagggaaaggtacctcagtctagtctctataataaaatagaagagatttagggaaatgttgaaattgtgttaacaaggtcatttccaaggggaacatacaactgatgagaatgtatcaactcctttacattaaatatttgaacaggttttgaatgttatttttatcaagttaaaacaaacaaaaaatacagcttcttactctgttttctcttcttttagaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 9 - protein, 124 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGM

SEQ ID NO: 10 - protein, 170 aa, Homo sapiens
  MOD_RES (17)..(17): Selenocysteine
  MOD_RES (23)..(23): Selenocysteine
  MOD_RES (40)..(40): Selenocysteine
  MOD_RES (56)..(56): Selenocysteine
  MOD_RES (70)..(70): Selenocysteine
  MOD_RES (99)..(99): Selenocysteine
  MOD_RES (115)..(115): Selenocysteine
  MOD_RES (129)..(129): Selenocysteine
  MOD_RES (145)..(145): Selenocysteine
  MOD_RES (150)..(150): Selenocysteine
  MOD_RES (154)..(154): Selenocysteine
  MOD_RES (161)..(161): Selenocysteine
DLLENLGYSVVIKENLXAQEMEXALRQFAAHPEHQSSDSXFLVFMSHSILNGICGXKHWDQEPDVLHDDXIFEIFNNRNCQSLKDKPKMVLGLFGSPLXVEKPVQILMVGSCKVXSVMMLLQRLMWKRXSLLSNLPHHVQHSFEXPNILXQLPXIERLSMXRYFYLFPGN

SEQ ID NO: 11 - protein, 294 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
  MOD_RES (141)..(141): Selenocysteine
  MOD_RES (147)..(147): Selenocysteine
  MOD_RES (164)..(164): Selenocysteine
  MOD_RES (180)..(180): Selenocysteine
  MOD_RES (194)..(194): Selenocysteine
  MOD_RES (223)..(223): Selenocysteine
  MOD_RES (239)..(239): Selenocysteine
  MOD_RES (253)..(253): Selenocysteine
  MOD_RES (269)..(269): Selenocysteine
  MOD_RES (274)..(274): Selenocysteine
  MOD_RES (278)..(278): Selenocysteine
  MOD_RES (285)..(285): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGMDLLENLGYSVVIKENLXAQEMEXALRQFAAHPEHQSSDSXFLVFMSHSILNGICGXKHWDQEPDVLHDDXIFEIFNNRNCQSLKDKPKMVLGLFGSPLXVEKPVQILMVGSCKVXSVMMLLQRLMWKRXSLLSNLPHHVQHSFEXPNILXQLPXIERLSMXRYFYLFPGN

SEQ ID NO: 12 - protein, 124 aa, Homo sapiens; identical to SEQ ID NO: 9
  MOD_RES (21)..(21): Selenocysteine
  MOD_RES (38)..(38): Selenocysteine
  MOD_RES (63)..(63): Selenocysteine
  MOD_RES (65)..(65): Selenocysteine

SEQ ID NO: 13 - protein, 152 aa, Homo sapiens
  MOD_RES (17)..(17): Selenocysteine
  MOD_RES (23)..(23): Selenocysteine
  MOD_RES (40)..(40): Selenocysteine
  MOD_RES (56)..(56): Selenocysteine
  MOD_RES (70)..(70): Selenocysteine
  MOD_RES (106)..(107): Selenocysteine
  MOD_RES (116)..(116): Selenocysteine
  MOD_RES (131)..(131): Selenocysteine
  MOD_RES (146)..(146): Selenocysteine
  MOD_RES (150)..(150): Selenocysteine
DLLENLGYSVVIKENLXAQEMEXALRQFAAHPEHQSSDSXFLVFMSHSILNGICGXKHWDQEPDVLHDDXIFEIFNNRNCQSLKDKPKVIIMQACRGNGAGIVWFXXDSGKASADXHGRLLQGNICNDAVXKAHVEKDFIAFKSSXPRSXFI

SEQ ID NO: 14 - protein, 276 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
  MOD_RES (141)..(141): Selenocysteine
  MOD_RES (147)..(147): Selenocysteine
  MOD_RES (164)..(164): Selenocysteine
  MOD_RES (180)..(180): Selenocysteine
  MOD_RES (194)..(194): Selenocysteine
  MOD_RES (230)..(231): Selenocysteine
  MOD_RES (240)..(240): Selenocysteine
  MOD_RES (255)..(255): Selenocysteine
  MOD_RES (270)..(270): Selenocysteine
  MOD_RES (274)..(274): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGMDLLENLGYSVVIKENLXAQEMEXALRQFAAHPEHQSSDSXFLVFMSHSILNGICGXKHWDQEPDVLHDDXIFEIFNNRNCQSLKDKPKVIIMQACRGNGAGIVWFXXDSGKASADXHGRLLQGNICNDAVXKAHVEKDFIAFKSSXPRSXFI

SEQ ID NO: 15 - protein, 124 aa, Homo sapiens; identical to SEQ ID NO: 9
  MOD_RES (21)..(21): Selenocysteine
  MOD_RES (38)..(38): Selenocysteine
  MOD_RES (63)..(63): Selenocysteine
  MOD_RES (65)..(65): Selenocysteine

SEQ ID NO: 16 - protein, 216 aa, Homo sapiens
  MOD_RES (17)..(17): Selenocysteine
  MOD_RES (23)..(23): Selenocysteine
  MOD_RES (40)..(40): Selenocysteine
  MOD_RES (56)..(56): Selenocysteine
  MOD_RES (70)..(70): Selenocysteine
  MOD_RES (106)..(107): Selenocysteine
  MOD_RES (116)..(116): Selenocysteine
  MOD_RES (131)..(131): Selenocysteine
  MOD_RES (146)..(146): Selenocysteine
  MOD_RES (156)..(156): Selenocysteine
  MOD_RES (191)..(191): Selenocysteine
  MOD_RES (196)..(196): Selenocysteine
  MOD_RES (200)..(200): Selenocysteine
  MOD_RES (207)..(207): Selenocysteine
DLLENLGYSVVIKENLXAQEMEXALRQFAAHPEHQSSDSXFLVFMSHSILNGICGXKHWDQEPDVLHDDXIFEIFNNRNCQSLKDKPKVIIMQACRGNGAGIVWFXXDSGKASADXHGRLLQGNICNDAVXKAHVEKDFIAFKSSXPHNVSWRHEXNGSVFISQIIYYFREYSWSHHLEEIFQKVQHSFEXPNILXQLPXIERLSMXRYFYLFPGN

SEQ ID NO: 17 - protein, 340 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
  MOD_RES (141)..(141): Selenocysteine
  MOD_RES (147)..(147): Selenocysteine
  MOD_RES (164)..(164): Selenocysteine
  MOD_RES (180)..(180): Selenocysteine
  MOD_RES (194)..(194): Selenocysteine
  MOD_RES (230)..(231): Selenocysteine
  MOD_RES (240)..(240): Selenocysteine
  MOD_RES (255)..(255): Selenocysteine
  MOD_RES (270)..(270): Selenocysteine
  MOD_RES (280)..(280): Selenocysteine
  MOD_RES (315)..(315): Selenocysteine
  MOD_RES (320)..(320): Selenocysteine
  MOD_RES (324)..(324): Selenocysteine
  MOD_RES (331)..(331): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGMDLLENLGYSVVIKENLXAQEMEXALRQFAAHPEHQSSDSXFLVFMSHSILNGICGXKHWDQEPDVLHDDXIFEIFNNRNCQSLKDKPKVIIMQACRGNGAGIVWFXXDSGKASADXHGRLLQGNICNDAVXKAHVEKDFIAFKSSXPHNVSWRHEXNGSVFISQIIYYFREYSWSHHLEEIFQKVQHSFEXPNILXQLPXIERLSMXRYFYLFPGN

SEQ ID NO: 18 - protein, 124 aa, Homo sapiens; identical to SEQ ID NO: 9
  MOD_RES (21)..(21): Selenocysteine
  MOD_RES (38)..(38): Selenocysteine
  MOD_RES (63)..(63): Selenocysteine
  MOD_RES (65)..(65): Selenocysteine

SEQ ID NO: 19 - protein, 99 aa, Homo sapiens
  MOD_RES (17)..(17): Selenocysteine
  MOD_RES (30)..(30): Selenocysteine
  MOD_RES (46)..(46): Selenocysteine
  MOD_RES (60)..(60): Selenocysteine
  MOD_RES (89)..(90): Selenocysteine
DLLENLGYSVVIKENLXAQMVLGLFGSPLXVEKPVQILMVGSCKVXSVMMLLQRLMWKRXSLLSNLPHHIMFLGDMKQMALSSFPKLSXXSESILGVII

SEQ ID NO: 20 - protein, 223 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
  MOD_RES (141)..(141): Selenocysteine
  MOD_RES (154)..(154): Selenocysteine
  MOD_RES (170)..(170): Selenocysteine
  MOD_RES (184)..(184): Selenocysteine
  MOD_RES (213)..(214): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGMDLLENLGYSVVIKENLXAQMVLGLFGSPLXVEKPVQILMVGSCKVXSVMMLLQRLMWKRXSLLSNLPHHIMFLGDMKQMALSSFPKLSXXSESILGVII

SEQ ID NO: 21 - protein, 124 aa, Homo sapiens; identical to SEQ ID NO: 9
  MOD_RES (21)..(21): Selenocysteine
  MOD_RES (38)..(38): Selenocysteine
  MOD_RES (63)..(63): Selenocysteine
  MOD_RES (65)..(65): Selenocysteine

SEQ ID NO: 22 - protein, 101 aa, Homo sapiens
  MOD_RES (17)..(17): Selenocysteine
  MOD_RES (30)..(30): Selenocysteine
  MOD_RES (46)..(46): Selenocysteine
  MOD_RES (60)..(60): Selenocysteine
  MOD_RES (76)..(76): Selenocysteine
  MOD_RES (81)..(81): Selenocysteine
  MOD_RES (85)..(85): Selenocysteine
  MOD_RES (92)..(92): Selenocysteine
DLLENLGYSVVIKENLXAQMVLGLFGSPLXVEKPVQILMVGSCKVXSVMMLLQRLMWKRXSLLSNLPHHVQHSFEXPNILXQLPXIERLSMXRYFYLFPGN

SEQ ID NO: 23 - protein, 224 aa, Homo sapiens
  MOD_RES (21)..(21): Selenocysteine
  MOD_RES (38)..(38): Selenocysteine
  MOD_RES (63)..(63): Selenocysteine
  MOD_RES (65)..(65): Selenocysteine
  MOD_RES (141)..(141): Selenocysteine
  MOD_RES (154)..(154): Selenocysteine
  MOD_RES (170)..(170): Selenocysteine
  MOD_RES (184)..(184): Selenocysteine
  MOD_RES (200)..(200): Selenocysteine
  MOD_RES (205)..(205): Selenocysteine
  MOD_RES (209)..(209): Selenocysteine
  MOD_RES (216)..(216): Selenocysteine
MADEKPSNGVLVHMVKLLIKXFLDGIFDDLMENNVLNXDEIHLIGKCLKFVVSNAENLVDDIXEXAQIAGKIFREHLWNSKKQLSSDISSDGEREANMPGLNIRNKEFNYLHNRNGSELDLLGMDLLENLGYSVVIKENLXAQMVLGLFGSPLXVEKPVQILMVGSCKVXSVMMLLQRLMWKRXSLLSNLPHHVQHSFEXPNILXQLPXIERLSMXRYFYLFPG

SEQ ID NO: 24 - protein, 40 aa, Homo sapiens
MADISSDGEREANMPGLNIRNKEFNYLHNRNGSELDLLGM

SEQ ID NO: 25 - protein, 216 aa, Homo sapiens; identical to SEQ ID NO: 16
  MOD_RES (17)..(17): Selenocysteine
  MOD_RES (23)..(23): Selenocysteine
  MOD_RES (40)..(40): Selenocysteine
  MOD_RES (56)..(56): Selenocysteine
  MOD_RES (70)..(70): Selenocysteine
  MOD_RES (106)..(107): Selenocysteine
  MOD_RES (116)..(116): Selenocysteine
  MOD_RES (131)..(131): Selenocysteine
  MOD_RES (146)..(146): Selenocysteine
  MOD_RES (156)..(156): Selenocysteine
  MOD_RES (191)..(191): Selenocysteine
  MOD_RES (196)..(196): Selenocysteine
  MOD_RES (200)..(200): Selenocysteine
  MOD_RES (207)..(207): Selenocysteine

SEQ ID NO: 26 - protein, 256 aa, Homo sapiens
  MOD_RES (57)..(57): Selenocysteine
  MOD_RES (63)..(63): Selenocysteine
  MOD_RES (80)..(80): Selenocysteine
  MOD_RES (96)..(96): Selenocysteine
  MOD_RES (110)..(110): Selenocysteine
  MOD_RES (146)..(147): Selenocysteine
  MOD_RES (156)..(156): Selenocysteine
  MOD_RES (171)..(171): Selenocysteine
  MOD_RES (186)..(186): Selenocysteine
  MOD_RES (196)..(196): Selenocysteine
  MOD_RES (231)..(231): Selenocysteine
  MOD_RES (236)..(236): Selenocysteine
  MOD_RES (240)..(240): Selenocysteine
  MOD_RES (247)..(247): Selenocysteine
MADISSDGEREANMPGLNIRNKEFNYLHNRNGSELDLLGMDLLENLGYSVVIKENLXAQEMEXALRQFAAHPEHQSSDSXFLVFMSHSILNGICGXKHWDQEPDVLHDDXIFEIFNNRNCQSLKDKPKVIIMQACRGNGAGIVWFXXDSGKASADXHGRLLQGNICNDAVXKAHVEKDFIAFKSSXPHNVSWRHEXNGSVFISQIIYYFREYSWSHHLEEIFQKVQHSFEXPNILXQLPXIERLSMXRYFYLFPGN

SEQ ID NO: 27 - protein, 40 aa, Homo sapiens; identical to SEQ ID NO: 24

SEQ ID NO: 28 - protein, 99 aa, Homo sapiens; identical to SEQ ID NO: 19
  MOD_RES (17)..(17): Selenocysteine
  MOD_RES (30)..(30): Selenocysteine
  MOD_RES (46)..(46): Selenocysteine
  MOD_RES (60)..(60): Selenocysteine
  MOD_RES (89)..(90): Selenocysteine

SEQ ID NO: 29 - protein, 139 aa, Homo sapiens
  MOD_RES (57)..(57): Selenocysteine
  MOD_RES (70)..(70): Selenocysteine
  MOD_RES (86)..(86): Selenocysteine
  MOD_RES (100)..(100): Selenocysteine
  MOD_RES (129)..(130): Selenocysteine
MADISSDGEREANMPGLNIRNKEFNYLHNRNGSELDLLGMDLLENLGYSVVIKENLXAQMVLGLFGSPLXVEKPVQILMVGSCKVXSVMMLLQRLMWKRXSLLSNLPHHIMFLGDMKQMALSSFPKLSXXSESILGVII

SEQ ID NO: 30 - protein, 40 aa, Homo sapiens; identical to SEQ ID NO: 24

SEQ ID NO: 31 - protein, 101 aa, Homo sapiens; identical to SEQ ID NO: 22
  MOD_RES (17)..(17): Selenocysteine
  MOD_RES (30)..(30): Selenocysteine
  MOD_RES (46)..(46): Selenocysteine
  MOD_RES (60)..(60): Selenocysteine
  MOD_RES (76)..(76): Selenocysteine
  MOD_RES (81)..(81): Selenocysteine
  MOD_RES (85)..(85): Selenocysteine
  MOD_RES (92)..(92): Selenocysteine

SEQ ID NO: 32 - protein, 141 aa, Homo sapiens
  MOD_RES (57)..(57): Selenocysteine
  MOD_RES (70)..(70): Selenocysteine
  MOD_RES (86)..(86): Selenocysteine
  MOD_RES (100)..(100): Selenocysteine
  MOD_RES (116)..(116): Selenocysteine
  MOD_RES (121)..(121): Selenocysteine
  MOD_RES (125)..(125): Selenocysteine
  MOD_RES (132)..(132): Selenocysteine
MADISSDGEREANMPGLNIRNKEFNYLHNRNGSELDLLGMDLLENLGYSVVIKENLXAQMVLGLFGSPLXVEKPVQILMVGSCKVXSVMMLLQRLMWKRXSLLSNLPHHVQHSFEXPNILXQLPXIERLSMXRYFYLFPGN

SEQ ID NO: 33 - protein, 180 aa, Homo sapiens
  MOD_RES (6)..(6): Selenocysteine
  MOD_RES (20)..(20): Selenocysteine
  MOD_RES (48)..(48): Selenocysteine
  MOD_RES (76)..(76): Selenocysteine
  MOD_RES (78)..(79): Selenocysteine
  MOD_RES (117)..(117): Selenocysteine
  MOD_RES (134)..(135): Selenocysteine
  MOD_RES (158)..(158): Selenocysteine
  MOD_RES (161)..(161): Selenocysteine
  MOD_RES (164)..(164): Selenocysteine
MDKNQXEVMREFFLSGFSQXPSIEAGLFVLFLFFYMSIWVGNVLIMVXVASDKYLNSSPMYFLLGNLSFLDLCYSXVXXPKLLADFFNHEKLISYDQCIVQLFFLHFVGAAEMFLLXVMAYDRYVAICRPLHYXXVMSRGLCCVLVAASWMGGFVHSXVQXILXVHLPFCGPNQVENFFL

SEQ ID NO: 34 - protein, 10 aa, Homo sapiens
  MOD_RES (7)..(7): Selenocysteine
CSPCHQXCLC

SEQ ID NO: 35 - protein, 4 aa, Homo sapiens
HFCH

SEQ ID NO: 36 - protein, 5 aa, Homo sapiens
IAHGI

SEQ ID NO: 37 - protein, 111 aa, Homo sapiens
  MOD_RES (33)..(33): Selenocysteine
  MOD_RES (45)..(45): Selenocysteine
  MOD_RES (49)..(49): Selenocysteine
  MOD_RES (70)..(70): Selenocysteine
  MOD_RES (85)..(85): Selenocysteine
QWVDLHHLLCGADFLLHHYPSQDSLQGRKAKGXLHVCLSPHGGNXVFWXLYFHLRSSFLYIFCGQDGVCXLQCYYPNAKPPHLHXSEQRGKVSHAEALGQKWAYLEKAGDM

SEQ ID NO: 38 - protein, 310 aa, Homo sapiens
  MOD_RES (6)..(6): Selenocysteine
  MOD_RES (20)..(20): Selenocysteine
  MOD_RES (48)..(48): Selenocysteine
  MOD_RES (76)..(76): Selenocysteine
  MOD_RES (78)..(79): Selenocysteine
  MOD_RES (117)..(117): Selenocysteine
  MOD_RES (134)..(135): Selenocysteine
  MOD_RES (158)..(158): Selenocysteine
  MOD_RES (161)..(161): Selenocysteine
  MOD_RES (164)..(164): Selenocysteine
  MOD_RES (187)..(187): Selenocysteine
  MOD_RES (232)..(232): Selenocysteine
  MOD_RES (244)..(244): Selenocysteine
  MOD_RES (248)..(248): Selenocysteine
  MOD_RES (269)..(269): Selenocysteine
  MOD_RES (284)..(284): Selenocysteine
MDKNQXEVMREFFLSGFSQXPSIEAGLFVLFLFFYMSIWVGNVLIMVXVASDKYLNSSPMYFLLGNLSFLDLCYSXVXXPKLLADFFNHEKLISYDQCIVQLFFLHFVGAAEMFLLXVMAYDRYVAICRPLHYXXVMSRGLCCVLVAASWMGGFVHSXVQXILXVHLPFCGPNQVENFFLCSPCHQXCLCHFCHIAHGIQWVDLHHLLCGADFLLHHYPSQDSLQGRKAKGXLHVCLSPHGGNXVFWXLYFHLRSSFLYIFCGQDGVCXLQCYYPNAKPPHLHXSEQRGKVSHAEALGQKWAYLEKAGDM

SEQ ID NO: 39 - DNA, 16 bp, Artificial Sequence
  source: /note="Description of Artificial Sequence: Synthetic oligonucleotide"
aaaatggcgccatttt

SEQ ID NO: 40 - DNA, 10 bp, Artificial Sequence
  source: /note="Description of Artificial Sequence: Synthetic oligonucleotide"
aaaccacaaa

SEQ ID NO: 41 - DNA, 10 bp, Artificial Sequence
  source: /note="Description of Artificial Sequence: Synthetic oligonucleotide"
aaagtaaaca

SEQ ID NO: 42 - DNA, 14 bp, Artificial Sequence
  source: /note="Description of Artificial Sequence: Synthetic oligonucleotide"
aaatggcgccattt

SEQ ID NO: 43 - DNA, 10 bp, Artificial Sequence
  source: /note="Description of Artificial Sequence: Synthetic oligonucleotide"
aacagctgtt

SEQ ID NO: 44 - DNA, 10 bp, Artificial Sequence
  source: /note="Description of Artificial Sequence: Synthetic oligonucleotide"
aacatctgga

SEQ ID NO: 45 - DNA, 10 bp, Artificial Sequence
  source: /note="Description of Artificial Sequence: Synthetic oligonucleotide"
aaccggaagt

SEQ ID NO: 46 - DNA, 10 bp, Artificial Sequence
  source: /note="Description of Artificial Sequence: Synthetic oligonucleotide"
aaccggaagt

SEQ ID NO: 47 - DNA, 10 bp, Artificial Sequence
  source: /note="Description of Artificial Sequence: Synthetic oligonucleotide"
aaccggaagt

SEQ ID NO: 48 - DNA, 12 bp, Artificial Sequence
  source: /note="Description of Artificial Sequence: Synthetic oligonucleotide"
aatggcgccaaa

SEQ ID NO: 49 - DNA, 12 bp, Artificial Sequence
  source: /note="Description of Artificial Sequence: Synthetic oligonucleotide"
aatggcgccaaa

SEQ ID NO: 50 - DNA, 13 bp, Artificial Sequence
  source: /note="Description of Artificial Sequence: Synthetic oligonucleotide"
aattggccaatta

SEQ ID NO: 51 - DNA, 10 bp, Artificial Sequence
  source: /note="Description of Artificial Sequence: Synthetic oligonucleotide"
acaggaagtg

SEQ ID NO: 52 - DNA, 10 bp, Artificial Sequence
  source: /note="Description of Artificial Sequence: Synthetic oligonucleotide"
acaggaagtg

SEQ ID NO: 53 - DNA, 10 bp, Artificial Sequence
  source: /note="Description of Artificial Sequence: Synthetic oligonucleotide"
acatcctggt

SEQ ID NO: 54 - DNA, 12 bp, Artificial Sequence
  source: /note="Description of Artificial Sequence: Synthetic oligonucleotide"
acccttgaaccc

SEQ ID NO: 55 - DNA, 10 bp, Artificial Sequence
  source: /note="Description of Artificial Sequence: Synthetic oligonucleotide"
accgaacaat

SEQ ID NO: 56 - DNA, 12 bp, Artificial Sequence
  source: /note="Description of Artificial Sequence: Synthetic oligonucleotide"
actacaattccc

SEQ ID NO: 57 - DNA, 10 bp, Artificial Sequence
  source: /note="Description of Artificial Sequence: Synthetic oligonucleotide"
actgaaacca

SEQ ID NO: 58 - DNA, 12 bp, Artificial Sequence
  source: /note="Description of Artificial Sequence: Synthetic oligonucleotide"
actttcactttc

SEQ ID NO: 59 - DNA, 15 bp, Artificial Sequence
  source: /note="Description of Artificial Sequence: Synthetic oligonucleotide"
agaaatgacttccct

SEQ ID NO: 60 - DNA, 10 bp, Artificial Sequence
  source: /note="Description of Artificial Sequence: Synthetic oligonucleotide"
agaggaagtg

SEQ ID NO: 61 - DNA, 12 bp, Artificial Sequence
  source: /note="Description of Artificial Sequence: Synthetic oligonucleotide"
aggtctctaacc

SEQ ID NO: 62 - DNA, 20 bp, Artificial Sequence
  source: /note="Description of Artificial Sequence: Synthetic oligonucleotide"
aggtgtgaaaaaaggtgtga

SEQ ID NO: 63 - DNA, 16 bp, Artificial Sequence
  source: /note="Description of Artificial Sequence: Synthetic oligonucleotide"
aggtgtgaaggtgtga

SEQ ID NO: 64 - DNA, 20 bp, Artificial Sequence
  source: /note="Description of Artificial Sequence: Synthetic oligonucleotide"
atagtgccacctggtggcca

SEQ ID NO: 65 - DNA, 15 bp, Artificial Sequence
  source: /note="Description of Artificial Sequence: Synthetic oligonucleotide"
atcaataacattgat

SEQ ID NO: 66 - DNA, 15 bp, Artificial Sequence
  source: /note="Description of Artificial Sequence: Synthetic oligonucleotide"
atcaattgcagtgat

SEQ ID NO: 67 - DNA, 10 bp, Artificial Sequence
  source: /note="Description of Artificial Sequence: Synthetic oligonucleotide"
atcacgtgat

SEQ ID NO: 68 - DNA, 10 bp, Artificial Sequence
  source: /note="Description of Artificial Sequence: Synthetic oligonucleotide"
atcacgtgat

SEQ ID NO: 69 - DNA, 15 bp, Artificial Sequence
  source: /note="Description of Artificial Sequence: Synthetic oligonucleotide"
atgaataacattcat

SEQ ID NO: 70 - DNA, 15 bp, Artificial Sequence
  source: /note="Description of Artificial Sequence: Synthetic oligonucleotide"
atgaattgcagtcat

SEQ ID NO: 71 - DNA, 10 bp, Artificial Sequence
  source: /note="Description of Artificial Sequence: Synthetic oligonucleotide"
atgacgtcat

SEQ ID NO: 72 - DNA, 10 bp, Artificial Sequence
  source: /note="Description of Artificial Sequence: Synthetic oligonucleotide"
atgactcatc

SEQ ID NO: 73 - DNA, 12 bp, Artificial Sequence
  source: /note="Description of Artificial Sequence: Synthetic oligonucleotide"
atgccctgaggc

SEQ ID NO: 74 - DNA, 10 bp, Artificial Sequence
  source: /note="Description of Artificial Sequence: Synthetic oligonucleotide"
attgcgcaac

SEQ ID NO: 75 - DNA, 12 bp, Artificial Sequence
  source: /note="Description of Artificial Sequence: Synthetic oligonucleotide"
caagatggcggc

SEQ ID NO: 76 - DNA, 11 bp, Artificial Sequence
  source: /note="Description of Artificial Sequence: Synthetic oligonucleotide"
caccgaacaat

SEQ ID NO: 77 - DNA, 12 bp, Artificial Sequence
  source: /note="Description of Artificial Sequence: Synthetic oligonucleotide"
ccatgccgccat

SEQ ID NO: 78 - DNA, 10 bp, Artificial Sequence
  source: /note="Description of Artificial Sequence: Synthetic oligonucleotide"
cgcagctgcg

SEQ ID NO: 79 - DNA, 10 bp, Artificial Sequence
  source: /note="Description of Artificial Sequence: Synthetic oligonucleotide"
cggacacaat

SEQ ID NO: 80 - DNA, 16 bp, Artificial Sequence
  source: /note="Description of Artificial Sequence: Synthetic oligonucleotide"
cggttgccatggcaac

SEQ ID NO: 81 - DNA, 10 bp, Artificial Sequence
  source: /note="Description of Artificial Sequence: Synthetic oligonucleotide"
cggtttcaaa

SEQ ID NO: 82 - DNA, 12 bp, Artificial Sequence
  source: /note="Description of Artificial Sequence: Synthetic oligonucleotide"
cgtgggtggtcc

SEQ ID NO: 83 - DNA, 12 bp, Artificial Sequence
  source: /note="Description of Artificial Sequence: Synthetic oligonucleotide"
ctgcgcatgcgc

SEQ ID NO: 84 - DNA, 12 bp, Artificial Sequence
  source: /note="Description of Artificial Sequence: Synthetic oligonucleotide"
gaaagtgaaagt

SEQ ID NO: 85 - DNA, 14 bp, Artificial Sequence
  source: /note="Description of Artificial Sequence: Synthetic oligonucleotide"
gaggtcaaaggtca

SEQ ID NO: 86 - DNA, 12 bp, Artificial Sequence
  source: /note="Description of Artificial Sequence: Synthetic oligonucleotide"
gatgacgtcatc

SEQ ID NO: 87 - DNA, 12 bp, Artificial Sequence
  source: /note="Description of Artificial Sequence: Synthetic oligonucleotide"
gatgactcagca

SEQ ID NO: 88 - DNA, 10 bp, Artificial Sequence
  source: /note="Description of Artificial Sequence: Synthetic oligonucleotide"
gattgcatca

SEQ ID NO: 89 - DNA, 16 bp, Artificial Sequence
  source: /note="Description of Artificial Sequence: Synthetic oligonucleotide"
gcagccaagcgtgacc

SEQ ID NO: 90 - DNA, 12 bp, Artificial Sequence
  source: /note="Description of Artificial Sequence: Synthetic oligonucleotide"
gcttttcccaca

SEQ ID NO: 91 - DNA, 12 bp, Artificial Sequence
  source: /note="Description of Artificial Sequence: Synthetic oligonucleotide"
ggccataaatca

SEQ ID NO: 92 - DNA, 12 bp, Artificial Sequence
  source: /note="Description of Artificial Sequence: Synthetic oligonucleotide"
gggggtgtgtcc

SEQ ID NO: 93 - DNA, 14 bp, Artificial Sequence
  source: /note="Description of Artificial Sequence: Synthetic oligonucleotide"
ggggtcaaaggtca

SEQ ID NO: 94 - DNA, 14 bp, Artificial Sequence
  source: /note="Description of Artificial Sequence: Synthetic oligonucleotide"
ggggtcaaaggtca

SEQ ID NO: 95 - DNA, 14 bp, Artificial Sequence
  source: /note="Description of Artificial Sequence: Synthetic oligonucleotide"
ggggtcaaaggtca

SEQ ID NO: 96 - DNA, 10 bp, Artificial Sequence
  source: /note="Description of Artificial Sequence: Synthetic oligonucleotide"
ggtcacgtga

SEQ ID NO: 97 - DNA, 12 bp, Artificial Sequence
  source: /note="Description of Artificial Sequence: Synthetic oligonucleotide"
ggtccctaggga

SEQ ID NO: 98 - DNA, 14 bp, Artificial Sequence
  source: /note="Description of Artificial Sequence: Synthetic oligonucleotide"
gtaaacatgtttac

SEQ ID NO: 99 - DNA, 14 bp, Artificial Sequence
  source: /note="Description of Artificial Sequence: Synthetic oligonucleotide"
gtaaacatgtttac

SEQ ID NO: 100 - DNA, 14 bp, Artificial Sequence
  source: /note="Description of Artificial Sequence: Synthetic oligonucleotide"
gtaaacatgtttac

SEQ ID NO: 101 - DNA, 14 bp, Artificial Sequence
  source: /note="Description of Artificial Sequence: Synthetic oligonucleotide"
gtaaacatgtttac

SEQ ID NO: 102 - DNA, 10 bp, Artificial Sequence
  source: /note="Description of Artificial Sequence: Synthetic oligonucleotide"
gtacctacct

SEQ ID NO: 103 - DNA, 10 bp, Artificial Sequence
  source: /note="Description of Artificial Sequence: Synthetic oligonucleotide"
gtcacgtgac

SEQ ID NO: 104 - DNA, 10 bp, Artificial Sequence
  source: /note="Description of Artificial Sequence: Synthetic oligonucleotide"
gtcacgtgac

SEQ ID NO: 105 - DNA, 12 bp, Artificial Sequence
  source: /note="Description of Artificial Sequence: Synthetic oligonucleotide"
gtccccagggga

SEQ ID NO: 106 - DNA, 12 bp, Artificial Sequence
  source: /note="Description of Artificial Sequence: Synthetic oligonucleotide"
gtgcgcatgcgc

SEQ ID NO: 107 - DNA, 10 bp, Artificial Sequence
  source: /note="Description of Artificial Sequence: Synthetic oligonucleotide"
gtgggcccca

SEQ ID NO: 108 - DNA, 16 bp, Artificial Sequence
  source: /note="Description of Artificial Sequence: Synthetic oligonucleotide"
tcacacctaggtgtga

SEQ ID NO: 109 - DNA, 16 bp, Artificial Sequence
  source: /note="Description of Artificial Sequence: Synthetic oligonucleotide"
tgacctttaaaggtca

SEQ ID NO: 110 - DNA, 14 bp, Artificial Sequence
  source: /note="Description of Artificial Sequence: Synthetic oligonucleotide"
tgatgacgtcatca

SEQ ID NO: 111 - DNA, 12 bp, Artificial Sequence
  source: /note="Description of Artificial Sequence: Synthetic oligonucleotide"
tgccacgtggca

SEQ ID NO: 112 - DNA, 10 bp, Artificial Sequence
  source: /note="Description of Artificial Sequence: Synthetic oligonucleotide"
tggcagttgg

SEQ ID NO: 113 - DNA, 13 bp, Artificial Sequence
  source: /note="Description of Artificial Sequence: Synthetic oligonucleotide"
ttgccatggcaac

SEQ ID NO: 114 - DNA, 11 bp, Artificial Sequence
  source: /note="Description of Artificial Sequence: Synthetic oligonucleotide"
tttaaaggtca

SEQ ID NO: 115 - DNA, 11 bp, Artificial Sequence
  source: /note="Description of Artificial Sequence: Synthetic oligonucleotide"
tttccccacac

SEQ ID NO: 116 - DNA, 12 bp, Artificial Sequence
  source: /note="Description of Artificial Sequence: Synthetic oligonucleotide"
tttccccacacg

SEQ ID NO: 117 - DNA, 12 bp, Artificial Sequence
  source: /note="Description of Artificial Sequence: Synthetic oligonucleotide"
tttccccacacg

SEQ ID NO: 118 - DNA, 12 bp, Artificial Sequence
  source: /note="Description of Artificial Sequence: Synthetic oligonucleotide"
tttcccgccaaa

SEQ ID NO: 119 - DNA, 12 bp, Artificial Sequence
  source: /note="Description of Artificial Sequence: Synthetic oligonucleotide"
tttggcgccaaa

SEQ ID NO: 120 - DNA, 12 bp, Artificial Sequence
  source: /note="Description of Artificial Sequence: Synthetic oligonucleotide"
tttggcgccaaa

SEQ ID NO: 121 - DNA, 14 bp, Artificial Sequence
  source: /note="Description of Artificial Sequence: Synthetic oligonucleotide"
ttttccatggaaaa

SEQ ID NO: 122 - DNA, 14 bp, Artificial Sequence
  source: /note="Description of Artificial Sequence: Synthetic oligonucleotide"
  modified_base (14)..(14): a, c, t, g, unknown or other
aaaaagcggaagtn

SEQ ID NO: 123 - DNA, 18 bp, Artificial Sequence
  source: /note="Description of Artificial Sequence: Synthetic oligonucleotide"
  modified_base (17)..(18): a, c, t, g, unknown or other
aaaaatggcgccaaaann

SEQ ID NO: 124 - DNA, 15 bp, Artificial Sequence
  source: /note="Description of Artificial Sequence: Synthetic oligonucleotide"
aaagatcaaaggrww

SEQ ID NO: 125 - DNA, 12 bp, Artificial Sequence
  source: /note="Description of Artificial Sequence: Synthetic oligonucleotide"
  modified_base (12)..(12): a, c, t, g, unknown or other
aacccggaagtn

SEQ ID NO: 126 - DNA, 12 bp, Artificial Sequence
  source: /note="Description of Artificial Sequence: Synthetic oligonucleotide"
aacccggaagtr

SEQ ID NO: 127 - DNA, 12 bp, Artificial Sequence
  source: /note="Description of Artificial Sequence: Synthetic oligonucleotide"
aacccggaagtr

SEQ ID NO: 128 - DNA, 14 bp, Artificial Sequence
  source: /note="Description of Artificial Sequence: Synthetic oligonucleotide"
  modified_base (13)..(14): a, c, t, g, unknown or other
aaccgttaacggnn

SEQ ID NO: 129 - DNA, 11 bp, Artificial Sequence
  source: /note="Description of Artificial Sequence: Synthetic oligonucleotide"
  modified_base (11)..(11): a, c, t, g, unknown or other
acccggaagtn

SEQ ID NO: 130 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 131 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 132 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 133 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 134 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 135 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 136 - DNA, 10 bp, Artificial Sequence
  source: /note="Description of Artificial Sequence: Synthetic oligonucleotide"
  modified_base (10)..(10): a, c, t, g, unknown or other
accggaagtn

SEQ ID NO: 137 - DNA, 10 bp, Artificial Sequence
  source: /note="Description of Artificial Sequence: Synthetic oligonucleotide"
  modified_base (10)..(10): a, c, t, g, unknown or other
accggaaryn

SEQ ID NO: 138 - DNA, 10 bp, Artificial Sequence
  source: /note="Description of Artificial Sequence: Synthetic oligonucleotide"
  modified_base (10)..(10): a, c, t, g, unknown or other
accggaaryn

SEQ ID NO: 139 - DNA, 10 bp, Artificial Sequence
  source: /note="Description of Artificial Sequence: Synthetic oligonucleotide"
  modified_base (10)..(10): a, c, t, g, unknown or other
accggaaryn

SEQ ID NO: 140 - DNA, 10 bp, Artificial Sequence
  source: /note="Description of Artificial Sequence: Synthetic oligonucleotide"
  modified_base (9)..(10): a, c, t, g, unknown or other
aggtgtgann

SEQ ID NO: 141 - DNA, 10 bp, Artificial Sequence
  source: /note="Description of Artificial Sequence: Synthetic oligonucleotide"
  modified_base (10)..(10): a, c, t, g, unknown or other
ccaataaaan

SEQ ID NO: 142 - DNA, 10 bp, Artificial Sequence
  source: /note="Description of Artificial Sequence: Synthetic oligonucleotide"
  modified_base (10)..(10): a, c, t, g, unknown or other
ccaataaaan

SEQ ID NO: 143 - DNA, 10 bp, Artificial Sequence
  source: /note="Description of Artificial Sequence: Synthetic oligonucleotide"
  modified_base (10)..(10): a, c, t, g, unknown or other
ccaataaaan

SEQ ID NO: 144 - DNA, 14 bp, Artificial Sequence
  source: /note="Description of Artificial Sequence: Synthetic oligonucleotide"
ccgaaaccgaaacy

SEQ ID NO: 145 - DNA, 10 bp, Artificial Sequence
  source: /note="Description of Artificial Sequence: Synthetic oligonucleotide"
ggcgggaaah

SEQ ID NO: 146 - DNA, 10 bp, Artificial Sequence
  source: /note="Description of Artificial Sequence: Synthetic oligonucleotide"
  modified_base (10)..(10): a, c, t, g, unknown or other
ggcgggaarn

SEQ ID NO: 147 - DNA, 11 bp, Artificial Sequence
  source: /note="Description of Artificial Sequence: Synthetic oligonucleotide"
  modified_base (11)..(11): a, c, t, g, unknown or other
tcaaggtcawn

SEQ ID NO: 148 - DNA, 17 bp, Artificial Sequence
  source: /note="Description of Artificial Sequence: Synthetic oligonucleotide"
tgctttctaggaattmm

SEQ ID NO: 149 - DNA, 12 bp, Artificial Sequence
  source: /note="Description of Artificial Sequence: Synthetic oligonucleotide"
tggggaagggcm

SEQ ID NO: 150 - DNA, 14 bp, Artificial Sequence
  source: /note="Description of Artificial Sequence: Synthetic oligonucleotide"
ttttcccgccaaaw

SEQ ID NO: 151 - DNA, 15 bp, Artificial Sequence
  source: /note="Description of Artificial Sequence: Synthetic oligonucleotide"
aacaatamcattgtt

SEQ ID NO: 152 - DNA, 15 bp, Artificial Sequence
  source: /note="Description of Artificial Sequence: Synthetic oligonucleotide"
  modified_base (8)..(8): a, c, t, g, unknown or other
aacaatancattgtt

SEQ ID NO: 153 - DNA, 15 bp, Artificial Sequence
  source: /note="Description of Artificial Sequence: Synthetic oligonucleotide"
  modified_base (8)..(8): a, c, t, g, unknown or other
aacaatknyagtgtt

SEQ ID NO: 154 - DNA, 15 bp, Artificial Sequence
  source: /note="Description of Artificial Sequence: Synthetic oligonucleotide"
  modified_base (7)..(8): a, c, t, g, unknown or other
aacaatnncattgtt

SEQ ID NO: 155 - DNA, 15 bp, Artificial Sequence
  source: /note="Description of Artificial Sequence: Synthetic oligonucleotide"
  modified_base (7)..(9): a, c, t, g, unknown or other
aacaatnnnagtgtt

SEQ ID NO: 156 - DNA, 16 bp, Artificial Sequence
  source: /note="Description of Artificial Sequence: Synthetic oligonucleotide"
  modified_base (7)..(9): a, c, t, g, unknown or other
aacaatnnncattgtt

SEQ ID NO: 157 - DNA, 10 bp, Artificial Sequence
  source: /note="Description of Artificial Sequence: Synthetic oligonucleotide"
aacavbtgtt

SEQ ID NO: 158 - DNA, 17 bp, Artificial Sequence
  source: /note="Description of Artificial Sequence: Synthetic oligonucleotide"
  modified_base (8)..(10): a, c, t, g, unknown or other
aaccggwnnnwccggtt

SEQ ID NO: 159 - DNA, 15 bp, Artificial Sequence
  source: /note="Description of Artificial Sequence: Synthetic oligonucleotide"
aagaacatwhtgttc

SEQ ID NO: 160 - DNA, 18 bp, Artificial Sequence
  source: /note="Description of Artificial Sequence: Synthetic oligonucleotide"
  modified_base (8)..(11): a, c, t, g, unknown or other
aaggtcannnnaaggtca

SEQ ID NO: 161 - DNA, 18 bp, Artificial Sequence
  source: /note="Description of Artificial Sequence: Synthetic oligonucleotide"
  modified_base (3)..(3): a, c, t, g, unknown or other
aantaggtcagtaggtca

SEQ ID NO: 162 - DNA, 16 bp, Artificial Sequence
  source: /note="Description of Artificial Sequence: Synthetic oligonucleotide"
aarggtcaaaaggtca

SEQ ID NO: 163 - DNA, 12 bp, Artificial Sequence
  source: /note="Description of Artificial Sequence: Synthetic oligonucleotide"
  modified_base (7)..(7): a, c, t, g, unknown or other
acaatancattg

SEQ ID NO: 164 - DNA, 14 bp, Artificial Sequence
  source: /note="Description of Artificial Sequence: Synthetic oligonucleotide"
accggawatccggt

SEQ ID NO: 165 - DNA, 14 bp, Artificial Sequence
  source: /note="Description of Artificial Sequence: Synthetic oligonucleotide"
accggawatccggt

SEQ ID NO: 166 - DNA, 16 bp, Artificial Sequence
  source: /note="Description of Artificial Sequence: Synthetic oligonucleotide"
accgttarraccgtta

SEQ ID NO: 167 - DNA, 14 bp, Artificial Sequence
  source: /note="Description of Artificial Sequence: Synthetic oligonucleotide"
actactawwwwtag

SEQ ID NO: 168 - DNA, 10 bp, Artificial Sequence
  source: /note="Description of Artificial Sequence: Synthetic oligonucleotide"
acvaggaagt

SEQ ID NO: 169 - DNA, 15 bp, Artificial Sequence
  source: /note="Description of Artificial Sequence: Synthetic oligonucleotide"
agatgkdgagataag

SEQ ID NO: 170 - DNA, 17 bp, Artificial Sequence
  source: /note="Description of Artificial Sequence: Synthetic oligonucleotide"
  modified_base (7)..(11): a, c, t, g, unknown or other
aggtcannnnntgacct

SEQ ID NO: 171 - DNA, 19 bp, Artificial Sequence
  source: /note="Description of Artificial Sequence: Synthetic oligonucleotide"
  modified_base (10)..(10): a, c, t, g, unknown or other
aggtgtgaanttcacacct

SEQ ID NO: 172 - DNA, 19 bp, Artificial Sequence
  source: /note="Description of Artificial Sequence: Synthetic oligonucleotide"
aggtgtgaawttcacacct

SEQ ID NO: 173 - DNA, 19 bp, Artificial Sequence
  source: /note="Description of Artificial Sequence: Synthetic oligonucleotide"
aggtgtgawwwtcacacct

SEQ ID NO: 174 - DNA, 18 bp, Artificial Sequence
  source: /note="Description of Artificial Sequence: Synthetic oligonucleotide"
agtgttaacagarcacct

SEQ ID NO: 175 - DNA, 10 bp, Artificial Sequence
  source: /note="Description of Artificial Sequence: Synthetic oligonucleotide"
  modified_base (2)..(2): a, c, t, g, unknown or other
anacagctgc

SEQ ID NO: 176 - DNA, 15 bp, Artificial Sequence
  source: /note="Description of Artificial Sequence: Synthetic oligonucleotide"
arggtcaaaaggtca

SEQ ID NO: 177 - DNA, 17 bp, Artificial Sequence
  source: /note="Description of Artificial Sequence: Synthetic oligonucleotide"
  modified_base (9)..(9): a, c, t, g, unknown or other
ataaacaanwgtaaaca

SEQ ID NO: 178 - DNA, 15 bp, Artificial Sequence
  source: /note="Description of Artificial Sequence: Synthetic oligonucleotide"
  modified_base (7)..(8): a, c, t, g, unknown or other
atcaatnncattgat

SEQ ID NO: 179 - DNA, 13 bp, Artificial Sequence
  source: /note="Description of Artificial Sequence: Synthetic oligonucleotide"
  modified_base (8)..(8): a, c, t, g, unknown or other
atgaatknyagtc

SEQ ID NO: 180 - DNA, 15 bp, Artificial Sequence
  source: /note="Description of Artificial Sequence: Synthetic oligonucleotide"
atgaatwycattcat

SEQ ID NO: 181 - DNA, 16 bp, Artificial Sequence
  source: /note="Description of Artificial Sequence: Synthetic oligonucleotide"
atgcgggyrcccgcat

SEQ ID NO: 182 - DNA, 14 bp, Artificial Sequence
  source: /note="Description of Artificial Sequence: Synthetic oligonucleotide"
atgmataattaatg

SEQ ID NO: 183 - DNA, 12 bp, Artificial Sequence
  source: /note="Description of Artificial Sequence: Synthetic oligonucleotide"
  modified_base (7)..(7): a, c, t, g, unknown or other
atttctnagaaa

SEQ ID NO: 184 - DNA, 10 bp, Artificial Sequence
  source: /note="Description of Artificial Sequence: Synthetic oligonucleotide"
avcaggaagt

SEQ ID NO: 185 - DNA, 17 bp, Artificial Sequence
  source: /note="Description of Artificial Sequence: Synthetic oligonucleotide"
  modified_base (7)..(11): a, c, t, g, unknown or other
cacgtgnnnnncacgtg

SEQ ID NO: 186 - DNA, 16 bp, Artificial Sequence
  source: /note="Description of Artificial Sequence: Synthetic oligonucleotide"
  modified_base (9)..(9): a, c, t, g, unknown or other
cttggcacngtgccaa

SEQ ID NO: 187 - DNA, 10 bp, Artificial Sequence
  source: /note="Description of Artificial Sequence: Synthetic oligonucleotide"
cwggcgggaa

SEQ ID NO: 188 - DNA, 14 bp, Artificial Sequence
  source: /note="Description of Artificial Sequence: Synthetic oligonucleotide"
  modified_base (12)..(13): a, c, t, g, unknown or other
gaccccccgcgnng

SEQ ID NO: 189 - DNA, 14 bp, Artificial Sequence
  source: /note="Description of Artificial Sequence: Synthetic oligonucleotide"
  modified_base (12)..(13): a, c, t, g, unknown or other
gaccccccgcgnng

SEQ ID NO: 190 - DNA, 10 bp, Artificial Sequence
  source: /note="Description of Artificial Sequence: Synthetic oligonucleotide"
gagsccgagc

SEQ ID NO: 191 - DNA, 15 bp, Artificial Sequence
  source: /note="Description of Artificial Sequence: Synthetic oligonucleotide"
gartggtcatcgccc

SEQ ID NO: 192 - DNA, 12 bp, Artificial Sequence
  source: /note="Description of Artificial Sequence: Synthetic oligonucleotide"
  modified_base (9)..(9): a, c, t, g, unknown or other
gcgaccacnctg

SEQ ID NO: 193 - DNA, 25 bp, Artificial Sequence
  source: /note="Description of Artificial Sequence: Synthetic oligonucleotide"
gggttttgaaggatgartaggagtt

SEQ ID NO: 194 - DNA, 15 bp, Artificial Sequence
  source: /note="Description of Artificial Sequence: Synthetic oligonucleotide"
  modified_base (3)..(3): a, c, t, g, unknown or other
ggntctcgcgagaac

SEQ ID NO: 195 - DNA, 16 bp, Artificial Sequence
  source: /note="Description of Artificial Sequence: Synthetic oligonucleotide"
  modified_base (8)..(9): a, c, t, g, unknown or other
ggtgtganntcacacc

SEQ ID NO: 196 - DNA, 16 bp, Artificial Sequence
  source: /note="Description of Artificial Sequence: Synthetic oligonucleotide"
ggtgtgawatcacacc

SEQ ID NO: 197 - DNA, 10 bp, Artificial Sequence
  source: /note="Description of Artificial Sequence: Synthetic oligonucleotide"
  modified_base (2)..(2): a, c, t, g, unknown or other
gnccacgtgg

SEQ ID NO: 198 - DNA, 12 bp, Artificial Sequence
  source: /note="Description of Artificial Sequence: Synthetic oligonucleotide"
gsctgtcactca

SEQ ID NO: 199 - DNA, 14 bp, Artificial Sequence
  source: /note="Description of Artificial Sequence: Synthetic oligonucleotide"
  modified_base (10)..(10): a, c, t, g, unknown or other
gtcacgctcnctga

SEQ ID NO: 200 - DNA, 15 bp, Artificial Sequence
  source: /note="Description of Artificial Sequence: Synthetic oligonucleotide"
gtggtcccggatyat

SEQ ID NO: 201 - DNA, 14 bp, Artificial Sequence
  source: /note="Description of Artificial Sequence: Synthetic oligonucleotide"
  modified_base (7)..(8): a, c, t, g, unknown or other
taattrnnyaatta

SEQ ID NO: 202 - DNA, 14 bp, Artificial Sequence
  source: /note="Description of Artificial Sequence: Synthetic oligonucleotide"
  modified_base (8)..(8): a, c, t, g, unknown or other
taattrsnyaatta

SEQ ID NO: 203 - DNA, 11 bp, Artificial Sequence
  source: /note="Description of Artificial Sequence: Synthetic oligonucleotide"
  modified_base (6)..(6): a, c, t, g, unknown or other
taatynaatta

SEQ ID NO: 204 - DNA, 10 bp, Artificial Sequence
  source: /note="Description of Artificial Sequence: Synthetic oligonucleotide"
taatyratta

SEQ ID NO: 205 - DNA, 10 bp, Artificial Sequence
  source: /note="Description of Artificial Sequence: Synthetic oligonucleotide"
taatyratta

SEQ ID NO: 206 - DNA, 11 bp, Artificial Sequence
  source: /note="Description of Artificial Sequence: Synthetic oligonucleotide"
taatytaatta

SEQ ID NO: 207 - DNA, 11 bp, Artificial Sequence
  source: /note="Description of Artificial Sequence: Synthetic oligonucleotide"
taatyyaatta

SEQ ID NO: 208 - DNA, 11 bp, Artificial Sequence
  source: /note="Description of Artificial Sequence: Synthetic oligonucleotide"
taatyyaatta

SEQ ID NO: 209 - DNA, 11 bp, Artificial Sequence
  source: /note="Description of Artificial Sequence: Synthetic oligonucleotide"
  modified_base (6)..(6): a, c, t, g, unknown or other
taayynaatta

SEQ ID NO: 210 - DNA, 13 bp, Artificial Sequence
  source: /note="Description of Artificial Sequence: Synthetic oligonucleotide"
  modified_base (7)..(7): a, c, t, g, unknown or other
tcaatancattga

SEQ ID NO: 211 - DNA, 13 bp, Artificial Sequence
  source: /note="Description of Artificial Sequence: Synthetic oligonucleotide"
  modified_base (6)..(7): a, c, t, g, unknown or other
tcaatnncattga

SEQ ID NO: 212 - DNA, 13 bp, Artificial Sequence
  source: /note="Description of Artificial Sequence: Synthetic oligonucleotide"
  modified_base (6)..(8): a, c, t, g, unknown or other
tcaatnnnattga

SEQ ID NO: 213 - DNA, 20 bp, Artificial Sequence
  source: /note="Description of Artificial Sequence: Synthetic oligonucleotide"
  modified_base (9)..(12): a, c, t, g, unknown or other
tcacacctnnnnaggtgtga

SEQ ID NO: 214 - DNA, 13 bp, Artificial Sequence
  source: /note="Description of Artificial Sequence: Synthetic oligonucleotide"
  modified_base (7)..(7): a, c, t, g, unknown or other
tgaatancattca

SEQ ID NO: 215 - DNA, 12 bp, Artificial Sequence
  source: /note="Description of Artificial Sequence: Synthetic oligonucleotide"
tgacagstgtca

SEQ ID NO: 216 - DNA, 12 bp, Artificial Sequence
  source: /note="Description of Artificial Sequence: Synthetic oligonucleotide"
tgacagstgtca

SEQ ID NO: 217 - DNA, 12 bp, Artificial Sequence
  source: /note="Description of Artificial Sequence: Synthetic oligonucleotide"
tgacagstgtca

SEQ ID NO: 218 - DNA, 12 bp, Artificial Sequence
  source: /note="Description of Artificial Sequence: Synthetic oligonucleotide"
tgacagstgtca

SEQ ID NO: 219 - DNA, 12 bp, Artificial Sequence
  source: /note="Description of Artificial Sequence: Synthetic oligonucleotide"
tgacagstgtca

SEQ ID NO: 220 - DNA, 12 bp, Artificial Sequence
  source: /note="Description of Artificial Sequence: Synthetic oligonucleotide"
tgacagstgtca

SEQ ID NO: 221 - DNA, 15 bp, Artificial Sequence
  source: /note="Description of Artificial Sequence: Synthetic oligonucleotide"
  modified_base (8)..(8): a, c, t, g, unknown or other
tgcacacnctgaaaa

SEQ ID NO: 222 - DNA, 10 bp, Artificial Sequence
  source: /note="Description of Artificial Sequence: Synthetic oligonucleotide"
tggaacagma

SEQ ID NO: 223 - DNA, 10 bp, Artificial Sequence
  source: /note="Description of Artificial Sequence: Synthetic oligonucleotide"
  modified_base (3)..(3): a, c, t, g, unknown or other
trngtaaaca

SEQ ID NO: 224 - DNA, 10 bp, Artificial Sequence
  source: /note="Description of Artificial Sequence: Synthetic oligonucleotide"
  modified_base (6)..(6): a, c, t, g, unknown or other
ttccknagaa

SEQ ID NO: 225 - DNA, 15 bp, Artificial Sequence
  source: /note="Description of Artificial Sequence: Synthetic oligonucleotide"
  modified_base (7)..(9): a, c, t, g, unknown or other
ttcgaannnttcgaa

SEQ ID NO: 226 - DNA, 13 bp, Artificial Sequence
  source: /note="Description of Artificial Sequence: Synthetic oligonucleotide"
  modified_base (9)..(10): a, c, t, g, unknown or other
ttctagaannttc

SEQ ID NO: 227 - DNA, 13 bp, Artificial Sequence
  source: /note="Description of Artificial Sequence: Synthetic oligonucleotide"
  modified_base (9)..(10): a, c, t, g, unknown or other
ttctagaannttc

SEQ ID NO: 228 - DNA, 13 bp, Artificial Sequence
  source: /note="Description of Artificial Sequence: Synthetic oligonucleotide"
  modified_base (9)..(10): a, c, t, g, unknown or other
ttctagaannttc

SEQ ID NO: 229 - DNA, 14 bp, Artificial Sequence
  source: /note="Description of Artificial Sequence: Synthetic oligonucleotide"
ttgacagstgtcaa

SEQ ID NO: 230 - DNA, 13 bp, Artificial Sequence
  source: /note="Description of Artificial Sequence: Synthetic oligonucleotide"
tttcaaggcyccc

SEQ ID NO: 231 - DNA, 15 bp, Artificial Sequence
  source: /note="Description of Artificial Sequence: Synthetic oligonucleotide"
  modified_base (8)..(8): a, c, t, g, unknown or other
tttccaynrtggaaa

SEQ ID NO: 232 - DNA, 14 bp, Artificial Sequence
  source: /note="Description of Artificial Sequence: Synthetic oligonucleotide"
tttccccacacrac

SEQ ID NO: 233 - DNA, 10 bp, Artificial Sequence
  source: /note="Description of Artificial Sequence: Synthetic oligonucleotide"
ttttatkrgg

SEQ ID NO: 234 - DNA, 14 bp, Artificial Sequence
  source: /note="Description of Artificial Sequence: Synthetic oligonucleotide"
  modified_base (14)..(14): a, c, t, g, unknown or other
aaaaagmggaagtn

SEQ ID NO: 235 - DNA, 14 bp, Artificial Sequence
  source: /note="Description of Artificial Sequence: Synthetic oligonucleotide"
  modified_base (7)..(7): a, c, t, g, unknown or other
  modified_base (14)..(14): a, c, t, g, unknown or other
aaaaagnggaagtn

SEQ ID NO: 236 - DNA, 11 bp, Artificial Sequence
  source: /note="Description of Artificial Sequence: Synthetic oligonucleotide"
aaccggaartr

SEQ ID NO: 237 - DNA, 10 bp, Artificial Sequence
  source: /note="Description of Artificial Sequence: Synthetic oligonucleotide"
  modified_base (10)..(10): a, c, t, g, unknown or other
accggaartn

SEQ ID NO: 238 - DNA, 10 bp, Artificial Sequence
  source: /note="Description of Artificial Sequence: Synthetic oligonucleotide"
  modified_base (10)..(10): a, c, t, g, unknown or other
accggaartn

SEQ ID NO: 239 - DNA, 14 bp, Artificial Sequence
  source: /note="Description of Artificial Sequence: Synthetic oligonucleotide"
  modified_base (14)..(14): a, c, t, g, unknown or other
accggawatccggn

SEQ ID NO: 240 - DNA, 10 bp, Artificial Sequence
  source: /note="Description of Artificial Sequence: Synthetic oligonucleotide"
  modified_base (10)..(10): a, c, t, g, unknown or other
accggawgyn

SEQ ID NO: 241 - DNA, 14 bp, Artificial Sequence
  source: /note="Description of Artificial Sequence: Synthetic oligonucleotide"
  modified_base (7)..(7): a, c, t, g, unknown or other
  modified_base (14)..(14): a, c, t, g, unknown or other
aggtcantgacctn

SEQ ID NO: 242 - DNA, 11 bp, Artificial Sequence
  source: /note="Description of Artificial Sequence: Synthetic oligonucleotide"
  modified_base (11)..(11): a, c, t, g, unknown or other
amccggatgtn

SEQ ID NO: 243 - DNA, 12 bp, Artificial Sequence
  source: /note="Description of Artificial Sequence: Synthetic oligonucleotide"
avytatcgatad

SEQ ID NO: 244 - DNA, 15 bp, Artificial Sequence
  source: /note="Description of Artificial Sequence: Synthetic oligonucleotide"
awcgaaaccgaaacy

SEQ ID NO: 245 - DNA, 10 bp, Artificial Sequence
  source: /note="Description of Artificial Sequence: Synthetic oligonucleotide"
  modified_base (10)..(10): a, c, t, g, unknown or other
cccatwaaan

SEQ ID NO: 246 - DNA, 15 bp, Artificial Sequence
  source: /note="Description of Artificial Sequence: Synthetic oligonucleotide"
  modified_base (15)..(15): a, c, t, g, unknown or other
ccggaascggaagtn

SEQ ID NO: 247 - DNA, 10 bp, Artificial Sequence
  source: /note="Description of Artificial Sequence: Synthetic oligonucleotide"
ccwggaatgy

SEQ ID NO: 248 - DNA, 10 bp, Artificial Sequence
  source: /note="Description of Artificial Sequence: Synthetic oligonucleotide"
ccwggaatgy

SEQ ID NO: 249 - DNA, 14 bp, Artificial Sequence
  source: /note="Description of Artificial Sequence: Synthetic oligonucleotide"
  modified_base (14)..(14): a, c, t, g, unknown or other
ctcgracccgtgcn

SEQ ID NO: 250 - DNA, 17 bp, Artificial Sequence
  source: /note="Description of Artificial Sequence: Synthetic oligonucleotide"
  modified_base (16)..(17): a, c, t, g, unknown or other
ctttcccmyaacacknn

SEQ ID NO: 251 - DNA, 10 bp, Artificial Sequence
  source: /note="Description of Artificial Sequence: Synthetic oligonucleotide"
  modified_base (10)..(10): a, c, t, g, unknown or other
cyaataaaan

SEQ ID NO: 252 - DNA, 12 bp, Artificial Sequence
  source: /note="Description of Artificial Sequence: Synthetic oligonucleotide"
gaaasygaaasy

SEQ ID NO: 253 - DNA, 14 bp, Artificial Sequence
  source: /note="Description of Artificial Sequence: Synthetic oligonucleotide"
  modified_base (14)..(14): a, c, t, g, unknown or other
gaatgacacrgcgn

SEQ ID NO: 254 - DNA, 20 bp, Artificial Sequence
  source: /note="Description of Artificial Sequence: Synthetic oligonucleotide"
gagcctggtactgwgcctgr

SEQ ID NO: 255 - DNA, 10 bp, Artificial Sequence
  source: /note="Description of Artificial Sequence: Synthetic oligonucleotide"
  modified_base (2)..(2): a, c, t, g, unknown or other
  modified_base (10)..(10): a, c, t, g, unknown or other
gncacgtgyn

SEQ ID NO: 256 - DNA, 10 bp, Artificial Sequence
  source: /note="Description of Artificial Sequence: Synthetic oligonucleotide"
  modified_base (10)..(10): a, c, t, g, unknown or other
gtaatwaaan

SEQ ID NO: 257 - DNA, 15 bp, Artificial Sequence
  source: /note="Description of Artificial Sequence: Synthetic oligonucleotide"
  modified_base (8)..(9): a, c, t, g, unknown or other
  modified_base (15)..(15): a, c, t, g, unknown or other
gtcacgcnnmattan

SEQ ID NO: 258 - DNA, 10 bp, Artificial Sequence
  source: /note="Description of Artificial Sequence: Synthetic oligonucleotide"
  modified_base (10)..(10): a, c, t, g, unknown or other
gtcgtwaaan

SEQ ID NO: 259 - DNA, 10 bp, Artificial Sequence
  source: /note="Description of Artificial Sequence: Synthetic oligonucleotide"
  modified_base (10)..(10): a, c, t, g, unknown or other
gtcgtwaaan

SEQ ID NO: 260 - DNA, 13 bp, Artificial Sequence
  source: /note="Description of Artificial Sequence: Synthetic oligonucleotide"
  modified_base (7)..(7): a, c, t, g, unknown or other
gttaatnattaay

SEQ ID NO: 261 - DNA, 10 bp, Artificial Sequence
  source: /note="Description of Artificial Sequence: Synthetic oligonucleotide"
  modified_base (10)..(10): a, c, t, g, unknown or other
taatcratan

SEQ ID NO: 262 - DNA, 10 bp, Artificial Sequence
  source: /note="Description of Artificial Sequence: Synthetic oligonucleotide"
  modified_base (10)..(10): a, c, t, g, unknown or other
taatcratan

SEQ ID NO: 263 - DNA, 10 bp, Artificial Sequence
  source: /note="Description of Artificial Sequence: Synthetic oligonucleotide"
trtttacttw

SEQ ID NO: 264 - DNA, 10 bp, Artificial Sequence
  source: /note="Description of Artificial Sequence: Synthetic oligonucleotide"
  modified_base (10)..(10): a, c, t, g, unknown or other
tsaaggtcan

SEQ ID NO: 265 - DNA, 15 bp, Artificial Sequence
  source: /note="Description of Artificial Sequence: Synthetic oligonucleotide"
  modified_base (7)..(9): a, c, t, g, unknown or other
ttggcannntgccar

SEQ ID NO: 266 - DNA, 15 bp, Artificial Sequence
  source: /note="Description of Artificial Sequence: Synthetic oligonucleotide"
  modified_base (7)..(9): a, c, t, g, unknown or other
ttggcannntgccar

SEQ ID NO: 267 - DNA, 15 bp, Artificial Sequence
  source: /note="Description of Artificial Sequence: Synthetic oligonucleotide"
  modified_base (7)..(9): a, c, t, g, unknown or other
aacaatnnnaktgtt

SEQ ID NO: 268 - DNA, 16 bp, Artificial Sequence
  source: /note="Description of Artificial Sequence: Synthetic oligonucleotide"
  modified_base (7)..(10): a, c, t, g, unknown or other
aacaatnnnnaktgtt

SEQ ID NO: 269 - DNA, 16 bp, Artificial Sequence
  source: /note="Description of Artificial Sequence: Synthetic oligonucleotide"
  modified_base (7)..(10): a, c, t, g, unknown or other
aacaatnnnnaktgtt

SEQ ID NO: 270 - DNA, 15 bp, Artificial Sequence
  source: /note="Description of Artificial Sequence: Synthetic oligonucleotide"
aaggkgrcgcaggca

SEQ ID NO: 271 - DNA, 14 bp, Artificial Sequence
  source: /note="Description of Artificial Sequence: Synthetic oligonucleotide"
accctmaaggtyrt

SEQ ID NO: 272 - DNA, 12 bp, Artificial Sequence
  source: /note="Description of Artificial Sequence: Synthetic oligonucleotide"
  modified_base (3)..(3): a, c, t, g, unknown or other
  modified_base (11)..(11): a, c, t, g, unknown or other
acngttaaacng

SEQ ID NO: 273 - DNA, 10 bp, Artificial Sequence
  source: /note="Description of Artificial Sequence: Synthetic oligonucleotide"
akgmcacgta

SEQ ID NO: 274 - DNA, 10 bp, Artificial Sequence
  source: /note="Description of Artificial Sequence: Synthetic oligonucleotide"
amcatatgkt

SEQ ID NO: 275 - DNA, 10 bp, Artificial Sequence
  source: /note="Description of Artificial Sequence: Synthetic oligonucleotide"
amcatatgkt

SEQ ID NO: 276 - DNA, 10 bp, Artificial Sequence
  source: /note="Description of Artificial Sequence: Synthetic oligonucleotide"
  modified_base (2)..(2): a, c, t, g, unknown or other
  modified_base (9)..(9): a, c, t, g, unknown or other
ancatatgnt

SEQ ID NO: 277 - DNA, 10 bp, Artificial Sequence
  source: /note="Description of Artificial Sequence: Synthetic oligonucleotide"
  modified_base (2)..(2): a, c, t, g, unknown or other
  modified_base (9)..(9): a, c, t, g, unknown or other
ancatatgnt

SEQ ID NO: 278 - DNA, 13 bp, Artificial Sequence
  source: /note="Description of Artificial Sequence: Synthetic oligonucleotide"
  modified_base (2)..(2): a, c, t, g, unknown or other
anrtaaayaaaca

SEQ ID NO: 279 - DNA, 18 bp, Artificial Sequence
  source: /note="Description of Artificial Sequence: Synthetic oligonucleotide"
  modified_base (9)..(11): a, c, t, g, unknown or other
arrggtcannnrrggtca

SEQ ID NO: 280 - DNA, 10 bp, Artificial Sequence
  source: /note="Description of Artificial Sequence: Synthetic oligonucleotide"
awcagctgwt

SEQ ID NO: 281 - DNA, 20 bp, Artificial Sequence
  source: /note="Description of Artificial Sequence: Synthetic oligonucleotide"
  modified_base (3)..(3): a, c, t, g, unknown or other
  modified_base (18)..(18): a, c, t, g, unknown or other
awntaggtcatgacctanwt

SEQ ID NO: 282 - DNA, 15 bp, Artificial Sequence
  source: /note="Description of Artificial Sequence: Synthetic oligonucleotide"
  modified_base (6)..(6): a, c, t, g, unknown or other
  modified_base (8)..(10): a, c, t, g, unknown or other
cccgcntnnnrcgaa

SEQ ID NO: 283 - DNA, 12 bp, Artificial Sequence
  source: /note="Description of Artificial Sequence: Synthetic oligonucleotide"
  modified_base (5)..(5): a, c, t, g, unknown or other
cgtrnaaartga

SEQ ID NO: 284 - DNA, 20 bp, Artificial Sequence
  source: /note="Description of Artificial Sequence: Synthetic oligonucleotide"
  modified_base (2)..(3): a, c, t, g, unknown or other
cnnbrgcgccccctgstggc

SEQ ID NO: 285 - DNA, 14 bp, Artificial Sequence
  source: /note="Description of Artificial Sequence: Synthetic oligonucleotide"
  modified_base (11)..(13): a, c, t, g, unknown or other
gaccacmcacnnng

SEQ ID NO: 286 - DNA, 11 bp, Artificial Sequence
  source: /note="Description of Artificial Sequence: Synthetic oligonucleotide"
gccmcgcccmc

SEQ ID NO: 287 - DNA, 11 bp, Artificial Sequence
  source: /note="Description of Artificial Sequence: Synthetic oligonucleotide"
gccmcgcccmc

SEQ ID NO: 288 - DNA, 11 bp, Artificial Sequence
  source: /note="Description of Artificial Sequence: Synthetic oligonucleotide"
gccmcgcccmc

SEQ ID NO: 289 - DNA, 10 bp, Artificial Sequence
  source: /note="Description of Artificial Sequence: Synthetic oligonucleotide"
  modified_base (2)..(2): a, c, t, g, unknown or other
  modified_base (9)..(9): a, c, t, g, unknown or other
gncacgtgnc

SEQ ID NO: 290 - DNA, 17 bp, Artificial Sequence
  source: /note="Description of Artificial Sequence: Synthetic oligonucleotide"
  modified_base (16)..(16): a, c, t, g, unknown or other
grggtcaaaaggtcana

SEQ ID NO: 291 - DNA, 16 bp, Artificial Sequence
  source: /note="Description of Artificial Sequence: Synthetic oligonucleotide"
grggtcaaaagktcac

SEQ ID NO: 292 - DNA, 16 bp, Artificial Sequence
  source: /note="Description of Artificial Sequence: Synthetic oligonucleotide"
  modified_base (8)..(9): a, c, t, g, unknown or other
grgttcannrrgttca

SEQ ID NO: 293 - DNA, 15 bp, Artificial Sequence
  source: /note="Description of Artificial Sequence: Synthetic oligonucleotide"
gtcwgctgtyyctct

SEQ ID NO: 294 - DNA, 10 bp, Artificial Sequence
  source: /note="Description of Artificial Sequence: Synthetic oligonucleotide"
gttgycatgg

SEQ ID NO: 295 - DNA, 12 bp, Artificial Sequence
  source: /note="Description of Artificial Sequence: Synthetic oligonucleotide"
gycatcmatcat

SEQ ID NO: 296 - DNA, 16 bp, Artificial Sequence
  source: /note="Description of Artificial Sequence: Synthetic oligonucleotide"
taattagyrytratta

SEQ ID NO: 297 - DNA, 13 bp, Artificial Sequence
  source: /note="Description of Artificial Sequence: Synthetic oligonucleotide"
taattrcyaatta

SEQ ID NO: 298 - DNA, 13 bp, Artificial Sequence
  source: /note="Description of Artificial Sequence: Synthetic oligonucleotide"
  modified_base (6)..(8): a, c, t, g, unknown or other
tgaatnnnaktca

SEQ ID NO: 299 - DNA, 14 bp, Artificial Sequence
  source: /note="Description of Artificial Sequence: Synthetic oligonucleotide"
tgaatrtkcagtca

SEQ ID NO: 300 - DNA, 14 bp, Artificial Sequence
  source: /note="Description of Artificial Sequence: Synthetic oligonucleotide"
tggkctarcctcga

SEQ ID NO: 301 - DNA, 17 bp, Artificial Sequence
  source: /note="Description of Artificial Sequence: Synthetic oligonucleotide"
  modified_base (7)..(7): a, c, t, g, unknown or other
  modified_base (12)..(13): a, c, t, g, unknown or other
tttcgcntggcnngtca

SEQ ID NO: 302 - DNA, 16 bp, Artificial Sequence
  source: /note="Description of Artificial Sequence: Synthetic oligonucleotide"
twcccayaatgcattg

SEQ ID NO: 303 - DNA, 20 bp, Artificial Sequence
  source: /note="Description of Artificial Sequence: Synthetic oligonucleotide"
  modified_base (7)..(7): a, c, t, g, unknown or other
  modified_base (9)..(10): a, c, t, g, unknown or other
  modified_base (20)..(20): a, c, t, g, unknown or other
agatstndnndsagataasn

SEQ ID NO: 304 - DNA, 15 bp, Artificial Sequence
  source: /note="Description of Artificial Sequence: Synthetic oligonucleotide"
argaggmcaaaatgw

SEQ ID NO: 305 - DNA, 15 bp, Artificial Sequence
  source: /note="Description of Artificial Sequence: Synthetic oligonucleotide"
atttcccagvakscy

SEQ ID NO: 306 - DNA, 16 bp, Artificial Sequence
  source: /note="Description of Artificial Sequence: Synthetic oligonucleotide"
aacaatrtkcagwgtt

SEQ ID NO: 307 - DNA, 16 bp, Artificial Sequence
  source: /note="Description of Artificial Sequence: Synthetic oligonucleotide"
aacaatrtkcagwgtt

SEQ ID NO: 308 - DNA, 16 bp, Artificial Sequence
  source: /note="Description of Artificial Sequence: Synthetic oligonucleotide"
aacaatrtkcagwgtt

SEQ ID NO: 309 - DNA, 15 bp, Artificial Sequence
  source: /note="Description of Artificial Sequence: Synthetic oligonucleotide"
adggyagyagcatct

SEQ ID NO: 310 - DNA, 16 bp, Artificial Sequence
  source: /note="Description of Artificial Sequence: Synthetic oligonucleotide"
  modified_base (9)..(9): a, c, t, g, unknown or other
aggtgtkanggtgtsa

SEQ ID NO: 311 - DNA, 18 bp, Artificial Sequence
  source: /note="Description of Artificial Sequence: Synthetic oligonucleotide"
  modified_base (9)..(10): a, c, t, g, unknown or other
aggtgtkanntmacacct

SEQ ID NO: 312 - DNA, 20 bp, Artificial Sequence
  source: /note="Description of Artificial Sequence: Synthetic oligonucleotide"
  modified_base (7)..(7): a, c, t, g, unknown or other
  modified_base (9)..(9): a, c, t, g, unknown or other
  modified_base (12)..(12): a, c, t, g, unknown or other
  modified_base (14)..(14): a, c, t, g, unknown or other
aggtgtnanwwntnacacct

SEQ ID NO: 313 - DNA, 20 bp, Artificial Sequence
  source: /note="Description of Artificial Sequence: Synthetic oligonucleotide"
  modified_base (7)..(7): a, c, t, g, unknown or other
  modified_base (9)..(9): a, c, t, g, unknown or other
  modified_base (12)..(12): a, c, t, g, unknown or other
  modified_base (14)..(14): a, c, t, g, unknown or other
aggtgtnanwwntnacacct

SEQ ID NO: 314 - DNA, 16 bp, Artificial Sequence
  source: /note="Description of Artificial Sequence: Synthetic oligonucleotide"
atcaatrtkcagwgat

SEQ ID NO: 315 - DNA, 17 bp, Artificial Sequence
  source: /note="Description of Artificial Sequence: Synthetic oligonucleotide"
  modified_base (7)..(11): a, c, t, g, unknown or other
atcratnnnnnatcrat

SEQ ID NO: 316 - DNA, 18 bp, Artificial Sequence
  source: /note="Description of Artificial Sequence: Synthetic oligonucleotide"
  modified_base (7)..(12): a, c, t, g, unknown or other
atcratnnnnnnatcrat

SEQ ID NO: 317 - DNA, 18 bp, Artificial Sequence
  source: /note="Description of Artificial Sequence: Synthetic oligonucleotide"
  modified_base (7)..(12): a, c, t, g, unknown or other
atcratnnnnnnatcrat

SEQ ID NO: 318 - DNA, 16 bp, Artificial Sequence
  source: /note="Description of Artificial Sequence: Synthetic oligonucleotide"
atgaatrtkcagwcat

SEQ ID NO: 319 - DNA, 25 bp, Artificial Sequence
  source: /note="Description of Artificial Sequence: Synthetic oligonucleotide"
cctcatggtgycytwytcccttgtg

SEQ ID NO: 320 - DNA, 14 bp, Artificial Sequence
  source: /note="Description of Artificial Sequence: Synthetic oligonucleotide"
  modified_base (13)..(13): a, c, t, g, unknown or other
gaccmccyrmtgng

SEQ ID NO: 321 - DNA, 18 bp, Artificial Sequence
  source: /note="Description of Artificial Sequence: Synthetic oligonucleotide"
  modified_base (6)..(6): a, c, t, g, unknown or other
  modified_base (8)..(8): a, c, t, g, unknown or other
  modified_base (11)..(11): a, c, t, g, unknown or other
  modified_base (13)..(13): a, c, t, g, unknown or other
ggtgtnanwwntnacacc

SEQ ID NO: 322 - DNA, 18 bp, Artificial Sequence
  source: /note="Description of Artificial Sequence: Synthetic oligonucleotide"
  modified_base (8)..(11): a, c, t, g, unknown or other
ggygtgannnntcacrcc

SEQ ID NO: 323 - DNA, 12 bp, Artificial Sequence
  source: /note="Description of Artificial Sequence: Synthetic oligonucleotide"
grtgmtrgagcc

SEQ ID NO: 324 - DNA, 16 bp, Artificial Sequence
  source: /note="Description of Artificial Sequence: Synthetic oligonucleotide"
  modified_base (7)..(10): a, c, t, g, unknown or other
taawygnnnntaawyg

SEQ ID NO: 325 - DNA, 14 bp, Artificial Sequence
  source: /note="Description of Artificial Sequence: Synthetic oligonucleotide"
tgaatrtkcagwca

SEQ ID NO: 326 - DNA, 11 bp, Artificial Sequence
  source: /note="Description of Artificial Sequence: Synthetic oligonucleotide"
  modified_base (10)..(10): a, c, t, g, unknown or other
tgmatwwwtna

SEQ ID NO: 327 - DNA, 10 bp, Artificial Sequence
  source: /note="Description of Artificial Sequence: Synthetic oligonucleotide"
tgyayggrtg

SEQ ID NO: 328 - DNA, 19 bp, Artificial Sequence
  source: /note="Description of Artificial Sequence: Synthetic oligonucleotide"
  modified_base (2)..(2): a, c, t, g, unknown or other
  modified_base (9)..(11): a, c, t, g, unknown or other
  modified_base (18)..(18): a, c, t, g, unknown or other
tnacacctnnnaggtgtna

SEQ ID NO: 329 - DNA, 15 bp, Artificial Sequence
  source: /note="Description of Artificial Sequence: Synthetic oligonucleotide"
trggtyastaggtca

SEQ ID NO: 330 - DNA, 23 bp, Artificial Sequence
  source: /note="Description of Artificial Sequence: Synthetic oligonucleotide"
  modified_base (11)..(13): a, c, t, g, unknown or other
tytcacacctnnnaggtgtgara

SEQ ID NO: 331 - DNA, 20 bp, Artificial Sequence
  source: /note="Description of Artificial Sequence: Synthetic oligonucleotide"
aaacykgttwdacmrgtttb

SEQ ID NO: 332 - DNA, 15 bp, Artificial Sequence
  source: /note="Description of Artificial Sequence: Synthetic oligonucleotide"
  modified_base (13)..(13): a, c, t, g, unknown or other
  modified_base (15)..(15): a, c, t, g, unknown or other
gacccccygytgngn

SEQ ID NO: 333 - DNA, 15 bp, Artificial Sequence
  source: /note="Description of Artificial Sequence: Synthetic oligonucleotide"
  modified_base (13)..(13): a, c, t, g, unknown or other
  modified_base (15)..(15): a, c, t, g, unknown or other
gacccccygytgngn

SEQ ID NO: 334 - DNA, 19 bp, Artificial Sequence
  source: /note="Description of Artificial Sequence: Synthetic oligonucleotide"
  modified_base (13)..(13): a, c, t, g, unknown or other
  modified_base (17)..(17): a, c, t, g, unknown or other
  modified_base (19)..(19): a, c, t, g, unknown or other
tttyacgcwtgantgmnyn

SEQ ID NO: 335 - DNA, 11 bp, Artificial Sequence
  source: /note="Description of Artificial Sequence: Synthetic oligonucleotide"
accytmarggt

SEQ ID NO: 336 - DNA, 17 bp, Artificial Sequence
  source: /note="Description of Artificial Sequence: Synthetic oligonucleotide"
  modified_base (2)..(2): a, c, t, g, unknown or other
  modified_base (11)..(11): a, c, t, g, unknown or other
  modified_base (13)..(13): a, c, t, g, unknown or other
cnattaaawancnatta

SEQ ID NO: 337 - DNA, 17 bp, Artificial Sequence
  source: /note="Description of Artificial Sequence: Synthetic oligonucleotide"
  modified_base (14)..(14): a, c, t, g, unknown or other
tagayraytgmcangaa

SEQ ID NO: 338 - DNA, 15 bp, Artificial Sequence
  source: /note="Description of Artificial Sequence: Synthetic oligonucleotide"
twghwacawtgtwdc

SEQ ID NO: 339 - DNA, 20 bp, Artificial Sequence
  source: /note="Description of Artificial Sequence: Synthetic oligonucleotide"
  modified_base (2)..(2): a, c, t, g, unknown or other
  modified_base (11)..(11): a, c, t, g, unknown or other
gnctgtastrntgbctchtt

SEQ ID NO: 340 - DNA, 10 bp, Artificial Sequence
  source: /note="Description of Artificial Sequence: Synthetic oligonucleotide"
kccacgtgac

SEQ ID NO: 341 - DNA, 11 bp, Artificial Sequence
  source: /note="Description of Artificial Sequence: Synthetic oligonucleotide"
mcgcccacgca

SEQ ID NO: 342 - DNA, 12 bp, Artificial Sequence
  source: /note="Description of Artificial Sequence: Synthetic oligonucleotide"
  modified_base (1)..(1): a, c, t, g, unknown or other
nacccggaagta

SEQ ID NO: 343 - DNA, 10 bp, Artificial Sequence
  source: /note="Description of Artificial Sequence: Synthetic oligonucleotide"
  modified_base (1)..(1): a, c, t, g, unknown or other
naggtgtgaa

SEQ ID NO: 344 - DNA, 10 bp, Artificial Sequence
  source: /note="Description of Artificial Sequence: Synthetic oligonucleotide"
  modified_base (1)..(1): a, c, t, g, unknown or other
natgcgggta

SEQ ID NO: 345 - DNA, 10 bp, Artificial Sequence
  source: /note="Description of Artificial Sequence: Synthetic oligonucleotide"
  modified_base (1)..(1): a, c, t, g, unknown or other
ncccccccac

SEQ ID NO: 346 - DNA, 14 bp, Artificial Sequence
  source: /note="Description of Artificial Sequence: Synthetic oligonucleotide"
  modified_base (1)..(1): a, c, t, g, unknown or other
ncgaaaccgaaact

SEQ ID NO: 347 - DNA, 10 bp, Artificial Sequence
  source: /note="Description of Artificial Sequence: Synthetic oligonucleotide"
  modified_base (1)..(2): a, c, t, g, unknown or other
nncacgtgcc

SEQ ID NO: 348 - DNA, 11 bp, Artificial Sequence
  source: /note="Description of Artificial Sequence: Synthetic oligonucleotide"
  modified_base (1)..(2): a, c, t, g, unknown or other
nngcggaagtg

SEQ ID NO: 349 - DNA, 12 bp, Artificial Sequence
  source: /note="Description of Artificial Sequence: Synthetic oligonucleotide"
  modified_base (1)..(1): a, c, t, g, unknown or other
ntgggtgtggcc

SEQ ID NO: 350 - DNA, 12 bp, Artificial Sequence
  source: /note="Description of Artificial Sequence: Synthetic oligonucleotide"
  modified_base (1)..(1): a, c, t, g, unknown or other
ntttccaggaaa

SEQ ID NO: 351 - DNA, 10 bp, Artificial Sequence
  source: /note="Description of Artificial Sequence: Synthetic oligonucleotide"
rccggaagtg

SEQ ID NO: 352 - DNA, 15 bp, Artificial Sequence
  source: /note="Description of Artificial Sequence: Synthetic oligonucleotide"
rrggtcaaaaggtca

SEQ ID NO: 353 - DNA, 14 bp, Artificial Sequence
  source: /note="Description of Artificial Sequence: Synthetic oligonucleotide"
rrggtcaaaggtca

SEQ ID NO: 354 - DNA, 14 bp, Artificial Sequence
  source: /note="Description of Artificial Sequence: Synthetic oligonucleotide"
rrggtcaaaggtca

SEQ ID NO: 355 - DNA, 14 bp, Artificial Sequence
  source: /note="Description of Artificial Sequence: Synthetic oligonucleotide"
rrggtcaaaggtca

SEQ ID NO: 356 - DNA, 15 bp, Artificial Sequence
  source: /note="Description of Artificial Sequence: Synthetic oligonucleotide"
rrgtccaaaggtcaa

SEQ ID NO: 357 - DNA, 13 bp, Artificial Sequence
  source: /note="Description of Artificial Sequence: Synthetic oligonucleotide"
rtaaacataaaca

SEQ ID NO: 358 - DNA, 10 bp, Artificial Sequence
  source: /note="Description of Artificial Sequence: Synthetic oligonucleotide"
rtcatgtgac

SEQ ID NO: 359 - DNA, 12 bp, Artificial Sequence
  source: /note="Description of Artificial Sequence: Synthetic oligonucleotide"
vdtttcccgcca

SEQ ID NO: 360 - DNA, 12 bp, Artificial Sequence
  source: /note="Description of Artificial Sequence: Synthetic oligonucleotide"
wacccggaagta

SEQ ID NO: 361 - DNA, 10 bp, Artificial Sequence
  source: /note="Description of Artificial Sequence: Synthetic oligonucleotide"
  modified_base (3)..(3): a, c, t, g, unknown or other
wdnctgggca

SEQ ID NO: 362 - DNA, 10 bp, Artificial Sequence
  source: /note="Description of Artificial Sequence: Synthetic oligonucleotide"
wwwwsygggg

SEQ ID NO: 363 - DNA, 10 bp, Artificial Sequence
  source: /note="Description of Artificial Sequence: Synthetic oligonucleotide"
ygtctagaca

SEQ ID NO: 364 - DNA, 13 bp, Artificial Sequence
  source: /note="Description of Artificial Sequence: Synthetic oligonucleotide"
  modified_base (2)..(4): a, c, t, g, unknown or other
  modified_base (10)..(12): a, c, t, g, unknown or other
dnnnggtcannnh

SEQ ID NO: 365 - DNA, 10 bp, Artificial Sequence
  source: /note="Description of Artificial Sequence: Synthetic oligonucleotide"
  modified_base (9)..(10): a, c, t, g, unknown or other
haataaagnn

SEQ ID NO: 366 - DNA, 15 bp, Artificial Sequence
  source: /note="Description of Artificial Sequence: Synthetic oligonucleotide"
  modified_base (2)..(2): a, c, t, g, unknown or other
  modified_base (4)..(4): a, c, t, g, unknown or other
  modified_base (13)..(13): a, c, t, g, unknown or other
hnhnaggtgtganhh

SEQ ID NO: 367 - DNA, 10 bp, Artificial Sequence
  source: /note="Description of Artificial Sequence: Synthetic oligonucleotide"
  modified_base (10)..(10): a, c, t, g, unknown or other
ksyggaagtn

SEQ ID NO: 368 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
naaaccggtttn

SEQ ID NO: 369 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
naaccgcaan

SEQ ID NO: 370 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
naaccggttn

SEQ ID NO: 371 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
naaccggttn

SEQ ID NO: 372 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nacacgtgtn

SEQ ID NO: 373 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nacccggaagtan

SEQ ID NO: 374 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
naccgaaacyn

SEQ ID NO: 375 - DNA, 14 bp, Artificial Sequence
  source: /note="Description of Artificial Sequence: Synthetic oligonucleotide"
  modified_base (1)..(1): a, c, t, g, unknown or other
  modified_base (13)..(14): a, c, t, g, unknown or other
nacgcccacgcann

SEQ ID NO: 376 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
naggtgtgaaawn

SEQ ID NO: 377 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
naggtgtgaan

SEQ ID NO: 378 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
naggtgtgaan

SEQ ID NO: 379 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
naggtgtgawn

SEQ ID NO: 380 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
natatgctaatkn

SEQ ID NO: 381 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
natgacgtcayn

SEQ ID NO: 382 - DNA, 12 bp, Artificial Sequence
  source: /note="Description of Artificial Sequence: Synthetic oligonucleotide"
  modified_base (1)..(1): a, c, t, g, unknown or other
natgcggaagtr

SEQ ID NO: 383 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
natgcgggtan

SEQ ID NO: 384 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
natgcgggtn

SEQ ID NO: 385 - DNA, 11 bp, Artificial Sequence
  source: /note="Description of Artificial Sequence: Synthetic oligonucleotide"
  modified_base (1)..(1): a, c, t, g, unknown or other
  modified_base (10)..(11): a, c, t, g, unknown or other
nccgccattnn

SEQ ID NO: 386 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nccgttaacggn

SEQ ID NO: 387 - DNA, 14 bp, Artificial Sequence
  source: /note="Description of Artificial Sequence: Synthetic oligonucleotide"
  modified_base (1)..(1): a, c, t, g, unknown or other
ncgaaaccgaaacy

SEQ ID NO: 388 - DNA, 15 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
ncgaaaccgaaacyn

SEQ ID NO: 389 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ncgaccaccgan

SEQ ID NO: 390 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nctaattann

SEQ ID NO: 391 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
nctcgtaaaan

SEQ ID NO: 392 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
nctcgtaaaan

SEQ ID NO: 393 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
nctcgtaaaan

SEQ ID NO: 394 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
nctcgtaaaan

SEQ ID NO: 395 - DNA, 14 bp, Artificial Sequence
  source: /note="Description of Artificial Sequence: Synthetic oligonucleotide"
  modified_base (1)..(1): a, c, t, g, unknown or other
ngatgacgtcatcr

SEQ ID NO: 396 - DNA, 12 bp, Artificial Sequence
  source: /note="Description of Artificial Sequence: Synthetic oligonucleotide"
  modified_base (1)..(1): a, c, t, g, unknown or other
  modified_base (11)..(12): a, c, t, g, unknown or other
ngcgaccaccnn

SEQ ID NO: 397 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nggcacgtgccn

SEQ ID NO: 398 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nggcacgtgccn

SEQ ID NO: 399 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ngtcgtaaaan

SEQ ID NO: 400 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ngtcgtaaaan

SEQ ID NO: 401 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nkcacgtgmn

SEQ ID NO: 402 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nkcacgtgmn

SEQ ID NO: 403 - DNA, 18 bp, Artificial Sequence
  source: /note="Description of Artificial Sequence: Synthetic oligonucleotide"
  modified_base (1)..(2): a, c, t, g, unknown or other
  modified_base (17)..(18): a, c, t, g, unknown or other
nnaaatggcgccaaaann

SEQ ID NO: 404 - DNA, 18 bp, Artificial Sequence
  source: /note="Description of Artificial Sequence: Synthetic oligonucleotide"
  modified_base (1)..(2): a, c, t, g, unknown or other
  modified_base (17)..(18): a, c, t, g, unknown or other
nnaaatggcgccatttnn

SEQ ID NO: 405 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nnaaccgttnn

SEQ ID NO: 406 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nnaaccgttnn

SEQ ID NO: 407 - DNA, 15 bp, Artificial Sequence
  source: /note="Description of Artificial Sequence: Synthetic oligonucleotide"
  modified_base (1)..(2): a, c, t, g, unknown or other
  modified_base (14)..(15): a, c, t, g, unknown or other
nnacgcccacgcann

SEQ ID NO: 408 - DNA, 16 bp, Artificial Sequence
  source: /note="Description of Artificial Sequence: Synthetic oligonucleotide"
  modified_base (1)..(2): a, c, t, g, unknown or other
  modified_base (14)..(16): a, c, t, g, unknown or other
nnacgcccacgcannn

SEQ ID NO: 409 - DNA, 14 bp, Artificial Sequence
  source: /note="Description of Artificial Sequence: Synthetic oligonucleotide"
  modified_base (1)..(2): a, c, t, g, unknown or other
  modified_base (13)..(14): a, c, t, g, unknown or other
nnatgacgtcatnn

SEQ ID NO: 410 - DNA, 10 bp, Artificial Sequence
  source: /note="Description of Artificial Sequence: Synthetic oligonucleotide"
  modified_base (1)..(2): a, c, t, g, unknown or other
  modified_base (10)..(10): a, c, t, g, unknown or other
nncacctgcn

SEQ ID NO: 411 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacctgnn

SEQ ID NO: 412 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacctgnn

SEQ ID NO: 413 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacctgnn

SEQ ID NO: 414 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacctgnn

SEQ ID NO: 415 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacgtgnn

SEQ ID NO: 416 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacgtgnn

SEQ ID NO: 417 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacgtgnn

SEQ ID NO: 418 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncacgtgnn

SEQ ID NO: 419 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncatatgnn

SEQ ID NO: 420 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nncatatgnn

SEQ ID NO: 421 - DNA, 11 bp, Artificial Sequence
  source: /note="Description of Artificial Sequence: Synthetic oligonucleotide"
  modified_base (1)..(2): a, c, t, g, unknown or other
  modified_base (10)..(10): a, c, t, g, unknown or other
nnccgccatnw

SEQ ID NO: 422 - DNA, 15 bp, Artificial Sequence
  source: /note="Description of Artificial Sequence: Synthetic oligonucleotide"
  modified_base (1)..(2): a, c, t, g, unknown or other
  modified_base (14)..(15): a, c, t, g, unknown or other
nngcaacaggtggnn

SEQ ID NO: 423 - DNA, 13 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
nngcaacaggtgn

SEQ ID NO: 424 - DNA, 16 bp, Artificial Sequence
  source: /note="Description of Artificial Sequence: Synthetic oligonucleotide"
  modified_base (1)..(2): a, c, t, g, unknown or other
  modified_base (15)..(16): a, c, t, g, unknown or other
nnggaagtgcttccnn

SEQ ID NO: 425 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnggattann

SEQ ID NO: 426 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnggattann

SEQ ID NO: 427 - DNA, 15 bp, Artificial Sequence
  source: /note="Description of Artificial Sequence: Synthetic oligonucleotide"
  modified_base (1)..(2): a, c, t, g, unknown or other
  modified_base (14)..(15): a, c, t, g, unknown or other
nnmcgcccacgcann

SEQ ID NO: 428 - DNA, 16 bp, Artificial Sequence
  source: /note="Description of Artificial Sequence: Synthetic oligonucleotide"
  modified_base (1)..(2): a, c, t, g, unknown or other
  modified_base (14)..(16): a, c, t, g, unknown or other
nnmcgcccacgcannn

SEQ ID NO: 429 - DNA, 12 bp, Artificial Sequence
  source: /note="Description of Artificial Sequence: Synthetic oligonucleotide"
  modified_base (1)..(5): a, c, t, g, unknown or other
  modified_base (12)..(12): a, c, t, g, unknown or other
nnnnntgctgan

SEQ ID NO: 430 - DNA, 11 bp, Artificial Sequence
  source: /note="Description of Artificial Sequence: Synthetic oligonucleotide"
  modified_base (1)..(4): a, c, t, g, unknown or other
  modified_base (11)..(11): a, c, t, g, unknown or other
nnnntgctgan

SEQ ID NO: 431 - DNA, 14 bp, Artificial Sequence
  source: /note="Description of Artificial Sequence: Synthetic oligonucleotide"
  modified_base (1)..(3): a, c, t, g, unknown or other
  modified_base (12)..(14): a, c, t, g, unknown or other
nnntggcgccannn

SEQ ID NO: 432 - DNA, 21 bp, Artificial Sequence
  source: /note="Description of Artificial Sequence: Synthetic oligonucleotide"
  modified_base (1)..(2): a, c, t, g, unknown or other
  modified_base (21)..(21): a, c, t, g, unknown or other
nnrraaaggaaaccgaaactn

SEQ ID NO: 433 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaaacgnn

SEQ ID NO: 434 - DNA, 15 bp, Artificial Sequence
  source: /note="Description of Artificial Sequence: Synthetic oligonucleotide"
  modified_base (1)..(2): a, c, t, g, unknown or other
  modified_base (14)..(15): a, c, t, g, unknown or other
nntaatccgattann

SEQ ID NO: 435 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaatccnn

SEQ ID NO: 436 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaatccnn

SEQ ID NO: 437 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaattann

SEQ ID NO: 438 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaattgnn

SEQ ID NO: 439 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntaattrnn

SEQ ID NO: 440 - DNA, 13 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
nntccagatgtkn

SEQ ID NO: 441 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nntgccaann

SEQ ID NO: 442 - DNA, 18 bp, Artificial Sequence
  source: /note="Description of Artificial Sequence: Synthetic oligonucleotide"
  modified_base (1)..(2): a, c, t, g, unknown or other
  modified_base (17)..(18): a, c, t, g, unknown or other
nnttttggcgccaaaann

SEQ ID NO: 443 - DNA, 18 bp, Artificial Sequence
  source: /note="Description of Artificial Sequence: Synthetic oligonucleotide"
  modified_base (1)..(2): a, c, t, g, unknown or other
  modified_base (17)..(18): a, c, t, g, unknown or other
nnttttggcgccaaaann

SEQ ID NO: 444 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 445 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 446 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 447 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 448 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 449 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 450 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 451 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 452 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 453 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 454 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 455 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 456 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 457 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnyaattann

SEQ ID NO: 458 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 459 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 460 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 461 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 462 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 463 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 464 - DNA, 10 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
nnymattann

SEQ ID NO: 465 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nnytaattann

SEQ ID NO: 466 - DNA, 15 bp, Artificial Sequence
  source: /note="Description of Artificial Sequence: Synthetic oligonucleotide"
  modified_base (1)..(2): a, c, t, g, unknown or other
  modified_base (14)..(14): a, c, t, g, unknown or other
nnyttccgggaarnr

SEQ ID NO: 467 - DNA, 15 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
nraaagtgaaagtgn

SEQ ID NO: 468 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nrcacctgnn

SEQ ID NO: 469 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nrcattccwn

SEQ ID NO: 470 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
nrgataatcyn

SEQ ID NO: 471 - DNA, 16 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
nrgtccaaagtccany

SEQ ID NO: 472 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nrttacgtaayn

SEQ ID NO: 473 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nrttacgtaayn

SEQ ID NO: 474 - DNA, 10 bp, Artificial Sequence
  source: /note="Description of Artificial Sequence: Synthetic oligonucleotide"
  modified_base (1)..(1): a, c, t, g, unknown or other
nryttccggh

SEQ ID NO: 475 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nstaattann

SEQ ID NO: 476 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nstaattann

SEQ ID NO: 477 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nstaattann

SEQ ID NO: 478 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ntcaaggtcan

SEQ ID NO: 479 - DNA, 12 bp, Artificial Sequence
  source: /note="Description of Artificial Sequence: Synthetic oligonucleotide"
  modified_base (1)..(1): a, c, t, g, unknown or other
  modified_base (11)..(12): a, c, t, g, unknown or other
nwaaccacadnn

SEQ ID NO: 480 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nytaattarn

SEQ ID NO: 481 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nytagttamn

SEQ ID NO: 482 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nyytgtttachn

SEQ ID NO: 483 - DNA, 10 bp, Artificial Sequence
  source: /note="Description of Artificial Sequence: Synthetic oligonucleotide"
racatatgty

SEQ ID NO: 484 - DNA, 18 bp, Artificial Sequence
  source: /note="Description of Artificial Sequence: Synthetic oligonucleotide"
  modified_base (18)..(18): a, c, t, g, unknown or other
raggtcaaaaggtcaakn

SEQ ID NO: 485 - DNA, 12 bp, Artificial Sequence
  source: /note="Description of Artificial Sequence: Synthetic oligonucleotide"
rcggacacaatr

SEQ ID NO: 486 - DNA, 12 bp, Artificial Sequence
  source: /note="Description of Artificial Sequence: Synthetic oligonucleotide"
rgggcactaacy

SEQ ID NO: 487 - DNA, 16 bp, Artificial Sequence
  source: /note="Description of Artificial Sequence: Synthetic oligonucleotide"
  modified_base (15)..(16): a, c, t, g, unknown or other
rrggtcaaagtccrnn

SEQ ID NO: 488 - DNA, 14 bp, Artificial Sequence
  source: /note="Description of Artificial Sequence: Synthetic oligonucleotide"
rrggtcatgaccyy

SEQ ID NO: 489 - DNA, 14 bp, Artificial Sequence
  source: /note="Description of Artificial Sequence: Synthetic oligonucleotide"
rrggtcatgaccyy

SEQ ID NO: 490 - DNA, 10 bp, Artificial Sequence
  source: /note="Description of Artificial Sequence: Synthetic oligonucleotide"
rtcacgtgay

SEQ ID NO: 491 - DNA, 10 bp, Artificial Sequence
  source: /note="Description of Artificial Sequence: Synthetic oligonucleotide"
rtcacgtgay

SEQ ID NO: 492 - DNA, 10 bp, Artificial Sequence
  source: /note="Description of Artificial Sequence: Synthetic oligonucleotide"
rtcacgtgay

SEQ ID NO: 493 - DNA, 10 bp, Artificial Sequence
  source: /note="Description of Artificial Sequence: Synthetic oligonucleotide"
rtcacgtgay

SEQ ID NO: 494 - DNA, 10 bp, Artificial Sequence
  source: /note="Description of Artificial Sequence: Synthetic oligonucleotide"
  modified_base (9)..(10): a, c, t, g, unknown or other
vcagctgbnn

SEQ ID NO: 495 - DNA, 10 bp, Artificial Sequence
  source: /note="Description of Artificial Sequence: Synthetic oligonucleotide"
watgcgcatw

SEQ ID NO: 496 - DNA, 14 bp, Artificial Sequence
  source: /note="Description of Artificial Sequence: Synthetic oligonucleotide"
  modified_base (14)..(14): a, c, t, g, unknown or other
wrcgtaaccacgyn

SEQ ID NO: 497 - DNA, 12 bp, Artificial Sequence
  source: /note="Description of Artificial Sequence: Synthetic oligonucleotide"
  modified_base (12)..(12): a, c, t, g, unknown or other
ygcgcatgcgcn

SEQ ID NO: 498 - DNA, 12 bp, Artificial Sequence
  source: /note="Description of Artificial Sequence: Synthetic oligonucleotide"
yrattgcaatyr

SEQ ID NO: 499 - DNA, 10 bp, Artificial Sequence
  source: /note="Description of Artificial Sequence: Synthetic oligonucleotide"
datgastcat

SEQ ID NO: 500 - DNA, 12 bp, Artificial Sequence
  source: /note="Description of Artificial Sequence: Synthetic oligonucleotide"
kgmcagcgtgtc

SEQ ID NO: 501 - DNA, 16 bp, Artificial Sequence
  source: /note="Description of Artificial Sequence: Synthetic oligonucleotide"
  modified_base (1)..(1): a, c, t, g, unknown or other
naacaattkcagtgtt

SEQ ID NO: 502 - DNA, 14 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
natttccnggaaat

SEQ ID NO: 503 - DNA, 11 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nccgccatnnt

SEQ ID NO: 504 - DNA, 10 bp, Artificial Sequence
  source: /note="Description of Artificial Sequence: Synthetic oligonucleotide"
  modified_base (1)..(1): a, c, t, g, unknown or other
ncyaataaaa

SEQ ID NO: 505 - DNA, 10 bp, Artificial Sequence
  source: /note="Description of Artificial Sequence: Synthetic oligonucleotide"
  modified_base (1)..(1): a, c, t, g, unknown or other
ngyaataaaa

SEQ ID NO: 506 - DNA, 17 bp, Artificial Sequence
  source: /note="Description of Artificial Sequence: Synthetic oligonucleotide"
  modified_base (1)..(2): a, c, t, g, unknown or other
  modified_base (15)..(15): a, c, t, g, unknown or other
nncatcccataatantc

SEQ ID NO: 507 - DNA, 20 bp, Artificial Sequence
  source: /note="Description of Artificial Sequence: Synthetic oligonucleotide"
  modified_base (1)..(3): a, c, t, g, unknown or other
  modified_base (12)..(12): a, c, t, g, unknown or other
nnngcatgtccngacatgcc

SEQ ID NO: 508 - DNA, 14 bp, Artificial Sequence
  source: /note="Description of Artificial Sequence: Synthetic oligonucleotide"
  modified_base (1)..(3): a, c, t, g, unknown or other
nnngmcacgtcatc

SEQ ID NO: 509 - DNA, 20 bp, Artificial Sequence
  source: /note="Description of Artificial Sequence: Synthetic oligonucleotide"
  modified_base (1)..(1): a, c, t, g, unknown or other
  modified_base (11)..(14): a, c, t, g, unknown or other
nraaggtcaannnnrggtca

SEQ ID NO: 510 - DNA, 14 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ntgccacgtcanca

SEQ ID NO: 511 - DNA, 18 bp, Artificial Sequence
  source: /note="Description of Artificial Sequence: Synthetic oligonucleotide"
  modified_base (1)..(1): a, c, t, g, unknown or other
  modified_base (11)..(12): a, c, t, g, unknown or other
nyaattaaaannyaatta

SEQ ID NO: 512 - DNA, 18 bp, Artificial Sequence
  source: /note="Description of Artificial Sequence: Synthetic oligonucleotide"
  modified_base (1)..(1): a, c, t, g, unknown or other
  modified_base (11)..(12): a, c, t, g, unknown or other
nyaattaaaannyaatta

SEQ ID NO: 513 - DNA, 18 bp, Artificial Sequence
  source: /note="Description of Artificial Sequence: Synthetic oligonucleotide"
  modified_base (9)..(10): a, c, t, g, unknown or other
racatgtynnracatgtc

SEQ ID NO: 514 - DNA, 17 bp, Artificial Sequence
  source: /note="Description of Artificial Sequence: Synthetic oligonucleotide"
  modified_base (8)..(8): a, c, t, g, unknown or other
raggtcantcaaggtca

SEQ ID NO: 515 - DNA, 17 bp, Artificial Sequence
  source: /note="Description of Artificial Sequence: Synthetic oligonucleotide"
  modified_base (8)..(8): a, c, t, g, unknown or other
raggtcantcaaggtca

SEQ ID NO: 516 - DNA, 14 bp, Artificial Sequence
  source: /note="Description of Artificial Sequence: Synthetic oligonucleotide"
  modified_base (8)..(8): a, c, t, g, unknown or other
ragtcaanaagtca

SEQ ID NO: 517 - DNA, 14 bp, Artificial Sequence
  source: /note="Description of Artificial Sequence: Synthetic oligonucleotide"
  modified_base (7)..(9): a, c, t, g, unknown or other
rgttcrnnnrgttc

SEQ ID NO: 518 - DNA, 10 bp, Artificial Sequence
  source: /note="Description of Artificial Sequence: Synthetic oligonucleotide"
rracgcsaaa

SEQ ID NO: 519 - DNA, 17 bp, Artificial Sequence
  source: /note="Description of Artificial Sequence: Synthetic oligonucleotide"
  modified_base (8)..(10): a, c, t, g, unknown or other
rrggtcannnrrggtca

SEQ ID NO: 520 - DNA, 14 bp, Artificial Sequence
  source: /note="Description of Artificial Sequence: Synthetic oligonucleotide"
rtaaacaataaaya

SEQ ID NO: 521 - DNA, 14 bp, Artificial Sequence
  source: /note="Description of Artificial Sequence: Synthetic oligonucleotide"
rtaaacartaaaca

SEQ ID NO: 522 - DNA, 13 bp, Artificial Sequence
  source: /note="Description of Artificial Sequence: Synthetic oligonucleotide"
rtaaacawmaaca

SEQ ID NO: 523 - DNA, 11 bp, Artificial Sequence
  source: /note="Description of Artificial Sequence: Synthetic oligonucleotide"
rtaaayaaaca

SEQ ID NO: 524 - DNA, 10 bp, Artificial Sequence
  source: /note="Description of Artificial Sequence: Synthetic oligonucleotide"
rtgtacggrt

SEQ ID NO: 525 - DNA, 19 bp, Artificial Sequence
  source: /note="Description of Artificial Sequence: Synthetic oligonucleotide"
rtgttaaaygtagattaag

SEQ ID NO: 526 - DNA, 13 bp, Artificial Sequence
  source: /note="Description of Artificial Sequence: Synthetic oligonucleotide"
wrtaaayaaacaa

SEQ ID NO: 527 - DNA, 15 bp, Artificial Sequence
  source: /note="Description of Artificial Sequence: Synthetic oligonucleotide"
  modified_base (9)..(9): a, c, t, g, unknown or other
yacgtaacnkacgta

SEQ ID NO: 528 - DNA, 11 bp, Artificial Sequence
  source: /note="Description of Artificial Sequence: Synthetic oligonucleotide"
yggcgctayca

SEQ ID NO: 529 - DNA, 15 bp, Artificial Sequence
  source: /note="Description of Artificial Sequence: Synthetic oligonucleotide"
  modified_base (7)..(9): a, c, t, g, unknown or other
ytggcannntgccaa

SEQ ID NO: 530 - DNA, 15 bp, Artificial Sequence
  source: /note="Description of Artificial Sequence: Synthetic oligonucleotide"
  modified_base (6)..(9): a, c, t, g, unknown or other
ytggcnnnntgccaa

SEQ ID NO: 531 - DNA, 11 bp, Artificial Sequence
  source: /note="Description of Artificial Sequence: Synthetic oligonucleotide"
tgrtagcgccr

SEQ ID NO: 532 - DNA, 12 bp, Artificial Sequence
  source: /note="Description of Artificial Sequence: Synthetic oligonucleotide"
kctawaaatagm

SEQ ID NO: 533 - DNA, 12 bp, Artificial Sequence
  source: /note="Description of Artificial Sequence: Synthetic oligonucleotide"
  modified_base (12)..(12): a, c, t, g, unknown or other
mccatatawggn

SEQ ID NO: 534 - DNA, 12 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
  modified_base (12)..(12): a, c, t, g, unknown or other
naaacgatnnan

SEQ ID NO: 535 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
naacaatancattgttn

SEQ ID NO: 536 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
naacaatknyagtgttn

SEQ ID NO: 537 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
naacaatknyagtgttn

SEQ ID NO: 538 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
naacaatnnnattgttn

SEQ ID NO: 539 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
naaccgcaaaccrcan

SEQ ID NO: 540 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
naaccgcaaaccrcan

SEQ ID NO: 541 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
naaccrcaan

SEQ ID NO: 542 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
naagacgycttn

SEQ ID NO: 543 - DNA, 12 bp, Artificial Sequence
  source: /note="Description of Artificial Sequence: Synthetic oligonucleotide"
  modified_base (1)..(1): a, c, t, g, unknown or other
  modified_base (4)..(4): a, c, t, g, unknown or other
naancgaaasyr

SEQ ID NO: 544 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
naasatcaaagn

SEQ ID NO: 545 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nacayatgnn

SEQ ID NO: 546 - DNA, 17 bp, Artificial Sequence
  source: /note="Description of Artificial Sequence: Synthetic oligonucleotide"
  modified_base (1)..(1): a, c, t, g, unknown or other
  modified_base (17)..(17): a, c, t, g, unknown or other
nacttccgscggaarmn

SEQ ID NO: 547 - DNA, 17 bp, Artificial Sequence
  source: /note="Description of Artificial Sequence: Synthetic oligonucleotide"
  modified_base (1)..(1): a, c, t, g, unknown or other
  modified_base (17)..(17): a, c, t, g, unknown or other
naggtcamsrtgacctn

SEQ ID NO: 548 - DNA, 12 bp, Artificial Sequence
  source: /note="Description of Artificial Sequence: Synthetic oligonucleotide"
  modified_base (1)..(1): a, c, t, g, unknown or other
namccggaagtr

SEQ ID NO: 549 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
natcaatancattgatn

SEQ ID NO: 550 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
natcaatknyagtgatn

SEQ ID NO: 551 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
natcaatknyagtgatn

SEQ ID NO: 552 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
natcaatnnnattgatn

SEQ ID NO: 553 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
natgaatknyagtcatn

SEQ ID NO: 554 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
natgastcatn

SEQ ID NO: 555 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nccacttran

SEQ ID NO: 556 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
nccggawatccggn

SEQ ID NO: 557 - DNA, 18 bp, Artificial Sequence
  source: /note="Description of Artificial Sequence: Synthetic oligonucleotide"
  modified_base (1)..(1): a, c, t, g, unknown or other
  modified_base (18)..(18): a, c, t, g, unknown or other
nccggawryrywtccggn

SEQ ID NO: 558 - DNA, 16 bp, Artificial Sequence
  source: /note="Description of Artificial Sequence: Synthetic oligonucleotide"
  modified_base (1)..(1): a, c, t, g, unknown or other
  modified_base (6)..(11): a, c, t, g, unknown or other
  modified_base (16)..(16): a, c, t, g, unknown or other
nccggnnnnnnccggn

SEQ ID NO: 559 - DNA, 14 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
ncgaaanygaaacy

SEQ ID NO: 560 - DNA, 12 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
  modified_base (12)..(12): a, c, t, g, unknown or other
ncgaccaccnan

SEQ ID NO: 561 - DNA, 12 bp, Artificial Sequence
  source: /note="Description of Artificial Sequence: Synthetic oligonucleotide"
  modified_base (1)..(1): a, c, t, g, unknown or other
nctawaaatagm

SEQ ID NO: 562 - DNA, 16 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
  modified_base (16)..(16): a, c, t, g, unknown or other
ngaccccccacgangn

SEQ ID NO: 563 - DNA, 20 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
  modified_base (18)..(20): a, c, t, g, unknown or other
ngaggtcanngagttcannn

SEQ ID NO: 564 - DNA, 12 bp, Artificial Sequence
  source: /note="Description of Artificial Sequence: Synthetic oligonucleotide"
  modified_base (1)..(1): a, c, t, g, unknown or other
  modified_base (5)..(8): a, c, t, g, unknown or other
  modified_base (12)..(12): a, c, t, g, unknown or other
ngccnnnnggcn

SEQ ID NO: 565 - DNA, 12 bp, Artificial Sequence
  source: /note="Description of Artificial Sequence: Synthetic oligonucleotide"
  modified_base (1)..(1): a, c, t, g, unknown or other
  modified_base (5)..(8): a, c, t, g, unknown or other
  modified_base (12)..(12): a, c, t, g, unknown or other
ngccnnnnggcn

SEQ ID NO: 566 - DNA, 12 bp, Artificial Sequence
  source: /note="Description of Artificial Sequence: Synthetic oligonucleotide"
  modified_base (1)..(1): a, c, t, g, unknown or other
  modified_base (5)..(8): a, c, t, g, unknown or other
  modified_base (12)..(12): a, c, t, g, unknown or other
ngccnnnnggcn

SEQ ID NO: 567 - DNA, 13 bp, Artificial Sequence
  source: /note="Description of Artificial Sequence: Synthetic oligonucleotide"
  modified_base (1)..(1): a, c, t, g, unknown or other
  modified_base (5)..(9): a, c, t, g, unknown or other
  modified_base (13)..(13): a, c, t, g, unknown or other
ngccnnnnnggcn

SEQ ID NO: 568 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nggggawtccccn

SEQ ID NO: 569 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nggggawtccccn

SEQ ID NO: 570 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ngtcgtwaaan

SEQ ID NO: 571 - DNA, 12 bp, Artificial Sequence
  source: /note="Description of Artificial Sequence: Synthetic oligonucleotide"
  modified_base (1)..(1): a, c, t, g, unknown or other
  modified_base (11)..(12): a, c, t, g, unknown or other
ngtcgtwaaann

SEQ ID NO: 572 - DNA, 10 bp, Artificial Sequence
  source: /note="Description of Artificial Sequence: Synthetic oligonucleotide"
  modified_base (1)..(1): a, c, t, g, unknown or other
nhaacbgyyv

SEQ ID NO: 573 - DNA, 14 bp, Artificial Sequence
  source: /note="Description of Artificial Sequence: Synthetic oligonucleotide"
  modified_base (1)..(1): a, c, t, g, unknown or other
  modified_base (13)..(14): a, c, t, g, unknown or other
nmcgcccmcgcann

SEQ ID NO: 574 - DNA, 14 bp, Artificial Sequence
  source: /note="Description of Artificial Sequence: Synthetic oligonucleotide"
  modified_base (1)..(2): a, c, t, g, unknown or other
  modified_base (13)..(14): a, c, t, g, unknown or other
nnaaaatcratann

SEQ ID NO: 575 - DNA, 14 bp, Artificial Sequence
  source: /note="Description of Artificial Sequence: Synthetic oligonucleotide"
  modified_base (1)..(2): a, c, t, g, unknown or other
  modified_base (14)..(14): a, c, t, g, unknown or other
nnaaaatcratawn

SEQ ID NO: 576 - DNA, 14 bp, Artificial Sequence
  source: /note="Description of Artificial Sequence: Synthetic oligonucleotide"
  modified_base (1)..(2): a, c, t, g, unknown or other
  modified_base (14)..(14): a, c, t, g, unknown or other
nnaaaatcratawn

SEQ ID NO: 577 - DNA, 13 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
nnatgaygcaatn

SEQ ID NO: 578 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nncamttaann

SEQ ID NO: 579 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nncamttaann

SEQ ID NO: 580 - DNA, 11 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
nncamttaann

SEQ ID NO: 581 - DNA, 16 bp, Artificial Sequence
  source: /note="Description of Artificial Sequence: Synthetic oligonucleotide"
  modified_base (1)..(2): a, c, t, g, unknown or other
  modified_base (15)..(16): a, c, t, g, unknown or other
nnmccatatawggknn

SEQ ID NO: 582 - DNA, 21 bp, Artificial Sequence
  source: /note="Description of Artificial Sequence: Synthetic oligonucleotide"
  modified_base (1)..(4): a, c, t, g, unknown or other
  modified_base (18)..(21): a, c, t, g, unknown or other
nnnntgctgastcagcannnn

SEQ ID NO: 583 - DNA, 21 bp, Artificial Sequence
  source: /note="Description of Artificial Sequence: Synthetic oligonucleotide"
  modified_base (1)..(4): a, c, t, g, unknown or other
  modified_base (18)..(21): a, c, t, g, unknown or other
nnnntgctgastcagcannnn

SEQ ID NO: 584 - DNA, 14 bp, Artificial Sequence
  source: /note="Description of Artificial Sequence: Synthetic oligonucleotide"
  modified_base (1)..(2): a, c, t, g, unknown or other
  modified_base (14)..(14): a, c, t, g, unknown or other
nnrtgacgtcaycn

SEQ ID NO: 585 - DNA, 15 bp, Artificial Sequence
  source: /note="Description of Artificial Sequence: Synthetic oligonucleotide"
  modified_base (1)..(2): a, c, t, g, unknown or other
  modified_base (14)..(15): a, c, t, g, unknown or other
nntaatccgmttann

SEQ ID NO: 586 - DNA, 14 bp, Artificial Sequence
  source: /note="Description of Artificial Sequence: Synthetic oligonucleotide"
  modified_base (1)..(2): a, c, t, g, unknown or other
  modified_base (7)..(8): a, c, t, g, unknown or other
  modified_base (13)..(14): a, c, t, g, unknown or other
nntcccnngggann

SEQ ID NO: 587 - DNA, 10 bp, Artificial Sequence
  source: /note="Description of Artificial Sequence: Synthetic oligonucleotide"
  modified_base (1)..(2): a, c, t, g, unknown or other
  modified_base (4)..(4): a, c, t, g, unknown or other
  modified_base (9)..(10): a, c, t, g, unknown or other
nntnattann

SEQ ID NO: 588 - DNA, 10 bp, Artificial Sequence
  source: /note="Description of Artificial Sequence: Synthetic oligonucleotide"
  modified_base (1)..(2): a, c, t, g, unknown or other
  modified_base (4)..(4): a, c, t, g, unknown or other
  modified_base (9)..(10): a, c, t, g, unknown or other
nntnattann

SEQ ID NO: 589 - DNA, 17 bp, Artificial Sequence
  source: /note="Description of Artificial Sequence: Synthetic oligonucleotide"
  modified_base (1)..(2): a, c, t, g, unknown or other
  modified_base (17)..(17): a, c, t, g, unknown or other
nnyatgmataattaatn

SEQ ID NO: 590 - DNA, 15 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
  modified_base (15)..(15): a, c, t, g, unknown or other
nrggtcannggtcan

SEQ ID NO: 591 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nrmatwccwn

SEQ ID NO: 592 - DNA, 14 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
  modified_base (12)..(12): a, c, t, g, unknown or other
  modified_base (14)..(14): a, c, t, g, unknown or other
nrnwaayrttknyn

SEQ ID NO: 593 - DNA, 14 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
  modified_base (12)..(12): a, c, t, g, unknown or other
  modified_base (14)..(14): a, c, t, g, unknown or other
nrnwaayrttknyn

SEQ ID NO: 594 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
nrttaatnattaacn

SEQ ID NO: 595 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
nrttaatnattaacn

SEQ ID NO: 596 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nrttacrtaayn

SEQ ID NO: 597 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nrttacrtaayn

SEQ ID NO: 598 - DNA, 11 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (11)..(11): a, c, t, g, unknown or other
nsccnnnggsn

SEQ ID NO: 599 - DNA, 11 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (11)..(11): a, c, t, g, unknown or other
nsccnnnggsn

SEQ ID NO: 600 - DNA, 11 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (11)..(11): a, c, t, g, unknown or other
nsccnnnggsn

SEQ ID NO: 601 - DNA, 13 bp, Artificial Sequence
  source: /note="Description of Artificial Sequence: Synthetic oligonucleotide"
  modified_base (1)..(1): a, c, t, g, unknown or other
  modified_base (5)..(9): a, c, t, g, unknown or other
  modified_base (13)..(13): a, c, t, g, unknown or other
nsccnnnnnggsn

SEQ ID NO: 602 - DNA, 13 bp, Artificial Sequence
  source: /note="Description of Artificial Sequence: Synthetic oligonucleotide"
  modified_base (1)..(1): a, c, t, g, unknown or other
  modified_base (5)..(9): a, c, t, g, unknown or other
  modified_base (13)..(13): a, c, t, g, unknown or other
nsccnnnnnggsn

SEQ ID NO: 603 - DNA, 13 bp, Artificial Sequence
  source: /note="Description of Artificial Sequence: Synthetic oligonucleotide"
  modified_base (1)..(1): a, c, t, g, unknown or other
  modified_base (5)..(9): a, c, t, g, unknown or other
  modified_base (13)..(13): a, c, t, g, unknown or other
nsccnnnnnggsn

SEQ ID NO: 604 - DNA, 10 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
nsctmattan

SEQ ID NO: 605 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
ntaattannntaattan

SEQ ID NO: 606 - DNA, 13 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (13)..(13): a, c, t, g, unknown or other
ntaatynrattan

SEQ ID NO: 607 - DNA, 13 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (13)..(13): a, c, t, g, unknown or other
ntaatynrattan

SEQ ID NO: 608 - DNA, 13 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (13)..(13): a, c, t, g, unknown or other
ntaatynrattan

SEQ ID NO: 609 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
ntaatytaattan

SEQ ID NO: 610 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
ntaatytaattan

SEQ ID NO: 611 - DNA, 13 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (13)..(13): a, c, t, g, unknown or other
ntaayynaattan

SEQ ID NO: 612 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
ntaayyyaattan

SEQ ID NO: 613 - DNA, 13 bp, Artificial Sequence
  source: /note="Description of Artificial Sequence: Synthetic oligonucleotide"
  modified_base (1)..(1): a, c, t, g, unknown or other
ntatcgcgayatr

SEQ ID NO: 614 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ntatgcwaatn

SEQ ID NO: 615 - DNA, 10 bp, Artificial Sequence
  source: /note="Description of Artificial Sequence: Synthetic oligonucleotide"
  modified_base (1)..(1): a, c, t, g, unknown or other
ntatygatch

SEQ ID NO: 616 - DNA, 15 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
  modified_base (15)..(15): a, c, t, g, unknown or other
ntgaatnncattcan

SEQ ID NO: 617 - DNA, 15 bp, Artificial Sequence
  source: /note="Description of Artificial Sequence: Synthetic oligonucleotide"
  modified_base (1)..(1): a, c, t, g, unknown or other
  modified_base (7)..(9): a, c, t, g, unknown or other
  modified_base (15)..(15): a, c, t, g, unknown or other
ntgaatnnnattcan

SEQ ID NO: 618 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
ntgaatwncattcan

SEQ ID NO: 619 - DNA, 19 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(19): a, c, t, g, unknown or other
ntgacctnnnnnaggtcan

SEQ ID NO: 620 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
ntgccacgtcaycn

SEQ ID NO: 621 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
ntgctgantcagcrn

SEQ ID NO: 622 - DNA, 15 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
ntgctgastcagcan

SEQ ID NO: 623 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
ntgmataattaatgan

SEQ ID NO: 624 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
ntmatcatcattan

SEQ ID NO: 625 - DNA, 10 bp, Artificial Sequence
  source: /note="Description of Artificial Sequence: Synthetic oligonucleotide"
  modified_base (1)..(1): a, c, t, g, unknown or other
nttrcgcaay

SEQ ID NO: 626 - DNA, 10 bp, Artificial Sequence
  source: /note="Description of Artificial Sequence: Synthetic oligonucleotide"
  modified_base (1)..(1): a, c, t, g, unknown or other
nttrcgcaay

SEQ ID NO: 627 - DNA, 10 bp, Artificial Sequence
  source: /note="Description of Artificial Sequence: Synthetic oligonucleotide"
  modified_base (1)..(1): a, c, t, g, unknown or other
nttrcgcaay

SEQ ID NO: 628 - DNA, 10 bp, Artificial Sequence
  source: /note="Description of Artificial Sequence: Synthetic oligonucleotide"
  modified_base (1)..(1): a, c, t, g, unknown or other
nttrcgcaay

SEQ ID NO: 629 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nwacayracawn

SEQ ID NO: 630 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nwacayracawn

SEQ ID NO: 631 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nwtatgcwaatn

SEQ ID NO: 632 - DNA, 13 bp, Artificial Sequence
  source: /note="Description of Artificial Sequence: Synthetic oligonucleotide"
  modified_base (1)..(1): a, c, t, g, unknown or other
nwtatgcwaattw

SEQ ID NO: 633 - DNA, 18 bp, Artificial Sequence
  source: /note="Description of Artificial Sequence: Synthetic oligonucleotide"
  modified_base (1)..(1): a, c, t, g, unknown or other
  modified_base (9)..(11): a, c, t, g, unknown or other
  modified_base (18)..(18): a, c, t, g, unknown or other
nyaattarnnnyaattan

SEQ ID NO: 634 - DNA, 10 bp, Artificial Sequence
  source: /note="Description of Artificial Sequence: Synthetic oligonucleotide"
  modified_base (1)..(1): a, c, t, g, unknown or other
  modified_base (9)..(10): a, c, t, g, unknown or other
nytmattann

SEQ ID NO: 635 - DNA, 15 bp, Artificial Sequence
  source: /note="Description of Artificial Sequence: Synthetic oligonucleotide"
  modified_base (12)..(12): a, c, t, g, unknown or other
raccgttaaacngyy

SEQ ID NO: 636 - DNA, 17 bp, Artificial Sequence
  source: /note="Description of Artificial Sequence: Synthetic oligonucleotide"
  modified_base (8)..(9): a, c, t, g, unknown or other
  modified_base (17)..(17): a, c, t, g, unknown or other
rcattccnnrcattccn

SEQ ID NO: 637 - DNA, 12 bp, Artificial Sequence
  source: /note="Description of Artificial Sequence: Synthetic oligonucleotide"
rctawaaatagm

SEQ ID NO: 638 - DNA, 16 bp, Artificial Sequence
  source: /note="Description of Artificial Sequence: Synthetic oligonucleotide"
  modified_base (8)..(10): a, c, t, g, unknown or other
  modified_base (16)..(16): a, c, t, g, unknown or other
rrggtcannnggtcan

SEQ ID NO: 639 - DNA, 10 bp, Artificial Sequence
  source: /note="Description of Artificial Sequence: Synthetic oligonucleotide"
  modified_base (9)..(10): a, c, t, g, unknown or other
sctmattann

SEQ ID NO: 640 - DNA, 12 bp, Artificial Sequence
  source: /note="Description of Artificial Sequence: Synthetic oligonucleotide"
  modified_base (11)..(11): a, c, t, g, unknown or other
wtatgcwaatnw

SEQ ID NO: 641 - DNA, 15 bp, Artificial Sequence
  source: /note="Description of Artificial Sequence: Synthetic oligonucleotide"
  modified_base (7)..(8): a, c, t, g, unknown or other
yaattannctaattr

SEQ ID NO: 642 - DNA, 14 bp, Artificial Sequence
  source: /note="Description of Artificial Sequence: Synthetic oligonucleotide"
ymattarytaatkr

SEQ ID NO: 643 - DNA, 14 bp, Artificial Sequence
  source: /note="Description of Artificial Sequence: Synthetic oligonucleotide"
ymattarytaatkr

SEQ ID NO: 644 - DNA, 20 bp, Artificial Sequence
  source: /note="Description of Artificial Sequence: Synthetic oligonucleotide"
  modified_base (10)..(11): a, c, t, g, unknown or other
ytcacacctnnaggtgtgar

SEQ ID NO: 645 - DNA, 10 bp, Artificial Sequence
  source: /note="Description of Artificial Sequence: Synthetic oligonucleotide"
dgggygkggc

SEQ ID NO: 646 - DNA, 15 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
ngaccacmcacgwng

SEQ ID NO: 647 - DNA, 14 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
ngccacgcccmcnt

SEQ ID NO: 648 - DNA, 16 bp, Artificial Sequence
  source: /note="Description of Artificial Sequence: Synthetic oligonucleotide"
  modified_base (1)..(1): a, c, t, g, unknown or other
ntgmataattaatkag

SEQ ID NO: 649 - DNA, 14 bp, Artificial Sequence
  source: /note="Description of Artificial Sequence: Synthetic oligonucleotide"
  modified_base (1)..(1): a, c, t, g, unknown or other
nwtatgcwaatkag

SEQ ID NO: 650 - DNA, 17 bp, Artificial Sequence
  source: /note="Description of Artificial Sequence: Synthetic oligonucleotide"
  modified_base (7)..(9): a, c, t, g, unknown or other
rggtcannnarrggtca

SEQ ID NO: 651 - DNA, 12 bp, Artificial Sequence
  source: /note="Description of Artificial Sequence: Synthetic oligonucleotide"
rgkgggcgkggc

SEQ ID NO: 652 - DNA, 18 bp, Artificial Sequence
  source: /note="Description of Artificial Sequence: Synthetic oligonucleotide"
  modified_base (8)..(10): a, c, t, g, unknown or other
rrggtcannnaraggtca

SEQ ID NO: 653 - DNA, 11 bp, Artificial Sequence
  source: /note="Description of Artificial Sequence: Synthetic oligonucleotide"
rtgtayggrtg

SEQ ID NO: 654 - DNA, 19 bp, Artificial Sequence
  source: /note="Description of Artificial Sequence: Synthetic oligonucleotide"
  modified_base (9)..(10): a, c, t, g, unknown or other
saaggtcanntsaaggtca

SEQ ID NO: 655 - DNA, 20 bp, Artificial Sequence
  source: /note="Description of Artificial Sequence: Synthetic oligonucleotide"
smcagtcwgakggaggaggc

SEQ ID NO: 656 - DNA, 12 bp, Artificial Sequence
  source: /note="Description of Artificial Sequence: Synthetic oligonucleotide"
wtatgcwaatka

SEQ ID NO: 657 - DNA, 25 bp, Artificial Sequence
  source: /note="Description of Artificial Sequence: Synthetic oligonucleotide"
maccttcyatggctccctaktgccy

SEQ ID NO: 658 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
naacaatknyaktgttn

SEQ ID NO: 659 - DNA, 12 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
  modified_base (10)..(10): a, c, t, g, unknown or other
  modified_base (12)..(12): a, c, t, g, unknown or other
nancatatgntn

SEQ ID NO: 660 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
natgaatknyaktcatn

SEQ ID NO: 661 - DNA, 20 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (20)..(20): a, c, t, g, unknown or other
natggaaanwwwwtttycmn

SEQ ID NO: 662 - DNA, 16 bp, Artificial Sequence
  source: /note="Description of Artificial Sequence: Synthetic oligonucleotide"
  modified_base (1)..(1): a, c, t, g, unknown or other
  modified_base (5)..(5): a, c, t, g, unknown or other
ncagnaagamgtawmm

SEQ ID NO: 663 - DNA, 17 bp, Artificial Sequence
  source: /note="Description of Artificial Sequence: Synthetic oligonucleotide"
  modified_base (1)..(1): a, c, t, g, unknown or other
  modified_base (17)..(17): a, c, t, g, unknown or other
ngcgccmyctagyggtn

SEQ ID NO: 664 - DNA, 15 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
  modified_base (13)..(13): a, c, t, g, unknown or other
ngntctagaaccngv

SEQ ID NO: 665 - DNA, 18 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
  modified_base (16)..(17): a, c, t, g, unknown or other
ngtcacgcwtsrntgnny

SEQ ID NO: 666 - DNA, 18 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
  modified_base (16)..(17): a, c, t, g, unknown or other
ngtcacgcwtsrntgnny

SEQ ID NO: 667 - DNA, 16 bp, Artificial Sequence
  source: /note="Description of Artificial Sequence: Synthetic oligonucleotide"
  modified_base (1)..(1): a, c, t, g, unknown or other
  modified_base (5)..(5): a, c, t, g, unknown or other
  modified_base (12)..(12): a, c, t, g, unknown or other
  modified_base (16)..(16): a, c, t, g, unknown or other
ngttnccatggnaacn

SEQ ID NO: 668 - DNA, 16 bp, Artificial Sequence
  source: /note="Description of Artificial Sequence: Synthetic oligonucleotide"
  modified_base (1)..(1): a, c, t, g, unknown or other
  modified_base (5)..(5): a, c, t, g, unknown or other
  modified_base (12)..(12): a, c, t, g, unknown or other
  modified_base (16)..(16): a, c, t, g, unknown or other
ngttnccatggnaacn

SEQ ID NO: 669 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
ngttrccatggyaacn

SEQ ID NO: 670 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
ngttrccatggyaacn

SEQ ID NO: 671 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ngyaatwaaan

SEQ ID NO: 672 - DNA, 11 bp, Artificial Sequence
  source: /note="Description of Artificial Sequence: Synthetic oligonucleotide"
  modified_base (1)..(1): a, c, t, g, unknown or other
  modified_base (11)..(11): a, c, t, g, unknown or other
ngyaatwaaan

SEQ ID NO: 673 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nmcmcgcccmcn

SEQ ID NO: 674 - DNA, 18 bp, Artificial Sequence
  source: /note="Description of Artificial Sequence: Synthetic oligonucleotide"
  modified_base (1)..(2): a, c, t, g, unknown or other
  modified_base (4)..(5): a, c, t, g, unknown or other
  modified_base (17)..(18): a, c, t, g, unknown or other
nngnnacgcccmytttnn

SEQ ID NO: 675 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
nrtmaatattkayn

SEQ ID NO: 676 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
nrtmaatattkayn

SEQ ID NO: 677 - DNA, 15 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
ntaattrgyaattan

SEQ ID NO: 678 - DNA, 18 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (11)..(11): a, c, t, g, unknown or other
  modified_base (18)..(18): a, c, t, g, unknown or other
ntgacctnatnaggtcan

SEQ ID NO: 679 - DNA, 18 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (11)..(11): a, c, t, g, unknown or other
  modified_base (18)..(18): a, c, t, g, unknown or other
ntgacctnatnaggtcan

SEQ ID NO: 680 - DNA, 17 bp, Artificial Sequence
  source: /note="Description of Artificial Sequence: Synthetic oligonucleotide"
  modified_base (1)..(1): a, c, t, g, unknown or other
  modified_base (17)..(17): a, c, t, g, unknown or other
ntgtttacrgtaaayan

SEQ ID NO: 681 - DNA, 13 bp, Artificial Sequence
  source: /note="Description of Artificial Sequence: Synthetic oligonucleotide"
  modified_base (1)..(1): a, c, t, g, unknown or other
  modified_base (6)..(6): a, c, t, g, unknown or other
  modified_base (13)..(13): a, c, t, g, unknown or other
ntrayntaatcan

SEQ ID NO: 682 - DNA, 17 bp, Artificial Sequence
  source: /note="Description of Artificial Sequence: Synthetic oligonucleotide"
  modified_base (1)..(1): a, c, t, g, unknown or other
  modified_base (16)..(17): a, c, t, g, unknown or other
nwrgccmcgcccmctnn

SEQ ID NO: 683 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
nwtrmatatkyawn

SEQ ID NO: 684 - DNA, 14 bp, Artificial Sequence
  source: /note="Description of Artificial Sequence: Synthetic oligonucleotide"
  modified_base (1)..(1): a, c, t, g, unknown or other
  modified_base (14)..(14): a, c, t, g, unknown or other
nwtrmatatkyawn

SEQ ID NO: 685 - DNA, 17 bp, Artificial Sequence
  source: /note="Description of Artificial Sequence: Synthetic oligonucleotide"
  modified_base (8)..(9): a, c, t, g, unknown or other
  modified_base (17)..(17): a, c, t, g, unknown or other
rcattccnnrcatwccn

SEQ ID NO: 686 - DNA, 14 bp, Artificial Sequence
  source: /note="Description of Artificial Sequence: Synthetic oligonucleotide"
  modified_base (9)..(9): a, c, t, g, unknown or other
  modified_base (13)..(14): a, c, t, g, unknown or other
rtggaaaantmcnn

SEQ ID NO: 687 - DNA, 15 bp, Artificial Sequence
  source: /note="Description of Artificial Sequence: Synthetic oligonucleotide"
sgttgcyargcaacs

SEQ ID NO: 688 - DNA, 15 bp, Artificial Sequence
  source: /note="Description of Artificial Sequence: Synthetic oligonucleotide"
sgttgcyargcaacs

SEQ ID NO: 689 - DNA, 15 bp, Artificial Sequence
  source: /note="Description of Artificial Sequence: Synthetic oligonucleotide"
sgttgcyargcaacs

SEQ ID NO: 690 - DNA, 16 bp, Artificial Sequence
  source: /note="Description of Artificial Sequence: Synthetic oligonucleotide"
sgttrccatrgcaacs

SEQ ID NO: 691 - DNA, 21 bp, Artificial Sequence
  source: /note="Description of Artificial Sequence: Synthetic oligonucleotide"
  modified_base (14)..(14): a, c, t, g, unknown or other
ssytaatcgrwaancgattar

SEQ ID NO: 692 - DNA, 12 bp, Artificial Sequence
  source: /note="Description of Artificial Sequence: Synthetic oligonucleotide"
wawrtaaayaww

SEQ ID NO: 693 - DNA, 18 bp, Artificial Sequence
  source: /note="Description of Artificial Sequence: Synthetic oligonucleotide"
  modified_base (2)..(2): a, c, t, g, unknown or other
  modified_base (17)..(17): a, c, t, g, unknown or other
wnwgtmaatattracwnw

SEQ ID NO: 694 - DNA, 11 bp, Artificial Sequence
  source: /note="Description of Artificial Sequence: Synthetic oligonucleotide"
  modified_base (11)..(11): a, c, t, g, unknown or other
wrwgtmaayan

SEQ ID NO: 695 - DNA, 11 bp, Artificial Sequence
  source: /note="Description of Artificial Sequence: Synthetic oligonucleotide"
wrwrtmaayaw

SEQ ID NO: 696 - DNA, 16 bp, Artificial Sequence
  source: /note="Description of Artificial Sequence: Synthetic oligonucleotide"
wtaatkagctmattaw

SEQ ID NO: 697 - DNA, 11 bp, Artificial Sequence
  source: /note="Description of Artificial Sequence: Synthetic oligonucleotide"
ymtgtmtytaw

SEQ ID NO: 698 - DNA, 20 bp, Artificial Sequence
  source: /note="Description of Artificial Sequence: Synthetic oligonucleotide"
  modified_base (1)..(1): a, c, t, g, unknown or other
ngtgttcavtsaagcgkaaa

SEQ ID NO: 699 - DNA, 13 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
nwtgmataawtna

SEQ ID NO: 700 - DNA, 17 bp, Artificial Sequence
  source: /note="Description of Artificial Sequence: Synthetic oligonucleotide"
  modified_base (13)..(13): a, c, t, g, unknown or other
sgtcacgcwtgantgma

SEQ ID NO: 701 - DNA, 17 bp, Artificial Sequence
  source: /note="Description of Artificial Sequence: Synthetic oligonucleotide"
  modified_base (13)..(13): a, c, t, g, unknown or other
sgtcacgcwtgantgma

SEQ ID NO: 702 - DNA, 15 bp, Artificial Sequence
  source: /note="Description of Artificial Sequence: Synthetic oligonucleotide"
  modified_base (9)..(9): a, c, t, g, unknown or other
vagracaknctgtbc

SEQ ID NO: 703 - DNA, 19 bp, Artificial Sequence
  source: /note="Description of Artificial Sequence: Synthetic oligonucleotide"
  modified_base (4)..(4): a, c, t, g, unknown or other
wawntrggtyagtaggtca

SEQ ID NO: 704 - DNA, 12 bp, Artificial Sequence
  source: /note="Description of Artificial Sequence: Synthetic oligonucleotide"
  modified_base (11)..(11): a, c, t, g, unknown or other
wtgmataawtna

SEQ ID NO: 705 - DNA, 12 bp, Artificial Sequence
  source: /note="Description of Artificial Sequence: Synthetic oligonucleotide"
  modified_base (11)..(11): a, c, t, g, unknown or other
wtgmataawtna

SEQ ID NO: 706 - DNA, 12 bp, Artificial Sequence
  source: /note="Description of Artificial Sequence: Synthetic oligonucleotide"
wtrmatatkyaw

SEQ ID NO: 707 - DNA, 12 bp, Artificial Sequence
  source: /note="Description of Artificial Sequence: Synthetic oligonucleotide"
wtrmatatkyaw

SEQ ID NO: 708 - DNA, 12 bp, Artificial Sequence
  source: /note="Description of Artificial Sequence: Synthetic oligonucleotide"
wtrmatatkyaw

SEQ ID NO: 709 - DNA, 25 bp, Artificial Sequence
  source: /note="Description of Artificial Sequence: Synthetic oligonucleotide"
  modified_base (21)..(21): a, c, t, g, unknown or other
ytkgatahagtattctwggtnggca

SEQ ID NO: 710 - DNA, 17 bp, Artificial Sequence
  source: /note="Description of Artificial Sequence: Synthetic oligonucleotide"
  modified_base (1)..(2): a, c, t, g, unknown or other
  modified_base (4)..(4): a, c, t, g, unknown or other
  modified_base (8)..(10): a, c, t, g, unknown or other
  modified_base (13)..(13): a, c, t, g, unknown or other
  modified_base (17)..(17): a, c, t, g, unknown or other
nncngttnnnacngttn

SEQ ID NO: 711 - DNA, 17 bp, Artificial Sequence
  source: /note="Description of Artificial Sequence: Synthetic oligonucleotide"
  modified_base (1)..(1): a, c, t, g, unknown or other
  modified_base (4)..(4): a, c, t, g, unknown or other
  modified_base (8)..(10): a, c, t, g, unknown or other
  modified_base (14)..(14): a, c, t, g, unknown or other
  modified_base (17)..(17): a, c, t, g, unknown or other
nrgnacannntgtncyn

SEQ ID NO: 712 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
nrgwacannntgtwcyn

SEQ ID NO: 713 - DNA, 20 bp, Artificial Sequence
  source: /note="Description of Artificial Sequence: Synthetic oligonucleotide"
  modified_base (1)..(1): a, c, t, g, unknown or other
  modified_base (10)..(11): a, c, t, g, unknown or other
  modified_base (20)..(20): a, c, t, g, unknown or other
ntgacctyanntraggtcan

SEQ ID NO: 714 - DNA, 17 bp, Artificial Sequence
  source: /note="Description of Artificial Sequence: Synthetic oligonucleotide"
  modified_base (4)..(4): a, c, t, g, unknown or other
  modified_base (14)..(14): a, c, t, g, unknown or other
raancgaaawtcgntty

SEQ ID NO: 715 - DNA, 17 bp, Artificial Sequence
  source: /note="Description of Artificial Sequence: Synthetic oligonucleotide"
  modified_base (8)..(10): a, c, t, g, unknown or other
rrgwacannntgtwcyy

SEQ ID NO: 716 - DNA, 18 bp, Artificial Sequence
  source: /note="Description of Artificial Sequence: Synthetic oligonucleotide"
  modified_base (18)..(18): a, c, t, g, unknown or other
waaccrcaawaaccrcan

SEQ ID NO: 717 - DNA, 18 bp, Artificial Sequence
  source: /note="Description of Artificial Sequence: Synthetic oligonucleotide"
  modified_base (18)..(18): a, c, t, g, unknown or other
waaccrcaawaaccrcan

SEQ ID NO: 718 - DNA, 20 bp, Artificial Sequence
  source: /note="Description of Artificial Sequence: Synthetic oligonucleotide"
  modified_base (1)..(2): a, c, t, g, unknown or other
  modified_base (9)..(9): a, c, t, g, unknown or other
  modified_base (12)..(12): a, c, t, g, unknown or other
  modified_base (19)..(20): a, c, t, g, unknown or other
nntcrcacntangtgygann

SEQ ID NO: 719 - DNA, 18 bp, Artificial Sequence
  source: /note="Description of Artificial Sequence: Synthetic oligonucleotide"
ywttkckktyyckgykky

SEQ ID NO: 720 - DNA, 11 bp, Artificial Sequence
  source: /note="Description of Artificial Sequence: Synthetic oligonucleotide"
accggaaatga

SEQ ID NO: 721 - DNA, 10 bp, Artificial Sequence
  source: /note="Description of Artificial Sequence: Synthetic oligonucleotide"
ccataaatca

SEQ ID NO: 722 - DNA, 12 bp, Artificial Sequence
  source: /note="Description of Artificial Sequence: Synthetic oligonucleotide"
taaacaggatta

SEQ ID NO: 723 - DNA, 16 bp, Artificial Sequence
  source: /note="Description of Artificial Sequence: Synthetic oligonucleotide"
  modified_base (15)..(16): a, c, t, g, unknown or other
accggaaacagctgnn

SEQ ID NO: 724 - DNA, 12 bp, Artificial Sequence
  source: /note="Description of Artificial Sequence: Synthetic oligonucleotide"
  modified_base (12)..(12): a, c, t, g, unknown or other
accggaaatgan

SEQ ID NO: 725 - DNA, 12 bp, Artificial Sequence
  source: /note="Description of Artificial Sequence: Synthetic oligonucleotide"
  modified_base (12)..(12): a, c, t, g, unknown or other
aggtgttaatkn

SEQ ID NO: 726 - DNA, 12 bp, Artificial Sequence
  source: /note="Description of Artificial Sequence: Synthetic oligonucleotide"
  modified_base (12)..(12): a, c, t, g, unknown or other
aggtgttgacan

SEQ ID NO: 727 - DNA, 13 bp, Artificial Sequence
  source: /note="Description of Artificial Sequence: Synthetic oligonucleotide"
  modified_base (13)..(13): a, c, t, g, unknown or other
ctcgtaaaatgyn

SEQ ID NO: 728 - DNA, 12 bp, Artificial Sequence
  source: /note="Description of Artificial Sequence: Synthetic oligonucleotide"
  modified_base (12)..(12): a, c, t, g, unknown or other
gaaaaccgaaan

SEQ ID NO: 729 - DNA, 14 bp, Artificial Sequence
  source: /note="Description of Artificial Sequence: Synthetic oligonucleotide"
  modified_base (14)..(14): a, c, t, g, unknown or other
ggaatgcggaagtn

SEQ ID NO: 730 - DNA, 13 bp, Artificial Sequence
  source: /note="Description of Artificial Sequence: Synthetic oligonucleotide"
ggaatgttaattr

SEQ ID NO: 731 - DNA, 15 bp, Artificial Sequence
  source: /note="Description of Artificial Sequence: Synthetic oligonucleotide"
  modified_base (15)..(15): a, c, t, g, unknown or other
gtgcgggcggaagtn

SEQ ID NO: 732 - DNA, 13 bp, Artificial Sequence
  source: /note="Description of Artificial Sequence: Synthetic oligonucleotide"
tcacaccggawry

SEQ ID NO: 733 - DNA, 13 bp, Artificial Sequence
  source: /note="Description of Artificial Sequence: Synthetic oligonucleotide"
  modified_base (11)..(13): a, c, t, g, unknown or other
tgttgccggannn

SEQ ID NO: 734 - DNA, 18 bp, Artificial Sequence
  source: /note="Description of Artificial Sequence: Synthetic oligonucleotide"
  modified_base (8)..(12): a, c, t, g, unknown or other
acaawrsnnnnnymatta

SEQ ID NO: 735 - DNA, 17 bp, Artificial Sequence
  source: /note="Description of Artificial Sequence: Synthetic oligonucleotide"
  modified_base (8)..(11): a, c, t, g, unknown or other
acaawrsnnnnymatta

SEQ ID NO: 736 - DNA, 16 bp, Artificial Sequence
  source: /note="Description of Artificial Sequence: Synthetic oligonucleotide"
  modified_base (8)..(10): a, c, t, g, unknown or other
acaawrsnnnymatta

SEQ ID NO: 737 - DNA, 17 bp, Artificial Sequence
  source: /note="Description of Artificial Sequence: Synthetic oligonucleotide"
aggtgtkaagtcgtaaa

SEQ ID NO: 738 - DNA, 23 bp, Artificial Sequence
  source: /note="Description of Artificial Sequence: Synthetic oligonucleotide"
  modified_base (7)..(17): a, c, t, g, unknown or other
cagctgnnnnnnnnnnntgcggg

SEQ ID NO: 739 - DNA, 21 bp, Artificial Sequence
  source: /note="Description of Artificial Sequence: Synthetic oligonucleotide"
  modified_base (7)..(15): a, c, t, g, unknown or other
cagctgnnnnnnnnntgcggg

SEQ ID NO: 740 - DNA, 20 bp, Artificial Sequence
  source: /note="Description of Artificial Sequence: Synthetic oligonucleotide"
  modified_base (7)..(14): a, c, t, g, unknown or other
cagctgnnnnnnnntgcggg

SEQ ID NO: 741 - DNA, 19 bp, Artificial Sequence
  source: /note="Description of Artificial Sequence: Synthetic oligonucleotide"
  modified_base (7)..(13): a, c, t, g, unknown or other
cagctgnnnnnnntgcggg

SEQ ID NO: 742 - DNA, 18 bp, Artificial Sequence
  source: /note="Description of Artificial Sequence: Synthetic oligonucleotide"
  modified_base (7)..(12): a, c, t, g, unknown or other
ccggaannnnnncacgtg

SEQ ID NO: 743 - DNA, 18 bp, Artificial Sequence
  source: /note="Description of Artificial Sequence: Synthetic oligonucleotide"
  modified_base (7)..(11): a, c, t, g, unknown or other
ggaatgnnnnnytaatta

SEQ ID NO: 744 - DNA, 21 bp, Artificial Sequence
  source: /note="Description of Artificial Sequence: Synthetic oligonucleotide"
  modified_base (7)..(15): a, c, t, g, unknown or other
ggattannnnnnnnntgcggg

SEQ ID NO: 745 - DNA, 19 bp, Artificial Sequence
  source: /note="Description of Artificial Sequence: Synthetic oligonucleotide"
  modified_base (7)..(13): a, c, t, g, unknown or other
ggattannnnnnntgcggg

SEQ ID NO: 746 - DNA, 18 bp, Artificial Sequence
  source: /note="Description of Artificial Sequence: Synthetic oligonucleotide"
  modified_base (7)..(12): a, c, t, g, unknown or other
ggattannnnnntgcggg

SEQ ID NO: 747 - DNA, 17 bp, Artificial Sequence
  source: /note="Description of Artificial Sequence: Synthetic oligonucleotide"
  modified_base (7)..(11): a, c, t, g, unknown or other
ggtgtgnnnnncacgtg

SEQ ID NO: 748 - DNA, 20 bp, Artificial Sequence
  source: /note="Description of Artificial Sequence: Synthetic oligonucleotide"
  modified_base (6)..(13): a, c, t, g, unknown or other
taatknnnnnnnnaaggtca

SEQ ID NO: 749 - DNA, 13 bp, Artificial Sequence
  source: /note="Description of Artificial Sequence: Synthetic oligonucleotide"
  modified_base (7)..(7): a, c, t, g, unknown or other
taatkrnggatta

SEQ ID NO: 750 - DNA, 15 bp, Artificial Sequence
  source: /note="Description of Artificial Sequence: Synthetic oligonucleotide"
  modified_base (7)..(10): a, c, t, g, unknown or other
taatkrnnnngcaac

SEQ ID NO: 751 - DNA, 16 bp, Artificial Sequence
  source: /note="Description of Artificial Sequence: Synthetic oligonucleotide"
  modified_base (7)..(10): a, c, t, g, unknown or other
taatkrnnnnggatta

SEQ ID NO: 752 - DNA, 16 bp, Artificial Sequence
  source: /note="Description of Artificial Sequence: Synthetic oligonucleotide"
  modified_base (7)..(10): a, c, t, g, unknown or other
taatkrnnnnggatta

SEQ ID NO: 753 - DNA, 16 bp, Artificial Sequence
  source: /note="Description of Artificial Sequence: Synthetic oligonucleotide"
  modified_base (7)..(11): a, c, t, g, unknown or other
taatkrnnnnngcaac

SEQ ID NO: 754 - DNA, 19 bp, Artificial Sequence
  source: /note="Description of Artificial Sequence: Synthetic oligonucleotide"
  modified_base (7)..(12): a, c, t, g, unknown or other
taatkrnnnnnnaaggtca

SEQ ID NO: 755 - DNA, 15 bp, Artificial Sequence
  source: /note="Description of Artificial Sequence: Synthetic oligonucleotide"
  modified_base (7)..(7): a, c, t, g, unknown or other
  modified_base (9)..(9): a, c, t, g, unknown or other
taatkrnrnggatta

SEQ ID NO: 756 - DNA, 18 bp, Artificial Sequence
  source: /note="Description of Artificial Sequence: Synthetic oligonucleotide"
  modified_base (7)..(12): a, c, t, g, unknown or other
taattannnnnncacgtg

SEQ ID NO: 757 - DNA, 16 bp, Artificial Sequence
  source: /note="Description of Artificial Sequence: Synthetic oligonucleotide"
  modified_base (6)..(10): a, c, t, g, unknown or other
tgacannnnntcatta

SEQ ID NO: 758 - DNA, 14 bp, Artificial Sequence
  source: /note="Description of Artificial Sequence: Synthetic oligonucleotide"
  modified_base (6)..(6): a, c, t, g, unknown or other
  modified_base (8)..(8): a, c, t, g, unknown or other
tgacansntaattg

SEQ ID NO: 759 - DNA, 12 bp, Artificial Sequence
  source: /note="Description of Artificial Sequence: Synthetic oligonucleotide"
tmacaccggaag

SEQ ID NO: 760 - DNA, 15 bp, Artificial Sequence
  source: /note="Description of Artificial Sequence: Synthetic oligonucleotide"
  modified_base (2)..(2): a, c, t, g, unknown or other
tntcacaccggaaat

SEQ ID NO: 761 - DNA, 16 bp, Artificial Sequence
  source: /note="Description of Artificial Sequence: Synthetic oligonucleotide"
  modified_base (8)..(8): a, c, t, g, unknown or other
  modified_base (16)..(16): a, c, t, g, unknown or other
acccgcanccggaagn

SEQ ID NO: 762 - DNA, 20 bp, Artificial Sequence
  source: /note="Description of Artificial Sequence: Synthetic oligonucleotide"
  modified_base (7)..(8): a, c, t, g, unknown or other
  modified_base (14)..(18): a, c, t, g, unknown or other
accgganntacgcnnnnnyr

SEQ ID NO: 763 - DNA, 12 bp, Artificial Sequence
  source: /note="Description of Artificial Sequence: Synthetic oligonucleotide"
  modified_base (6)..(6): a, c, t, g, unknown or other
aggtgntaatkr

SEQ ID NO: 764 - DNA, 12 bp, Artificial Sequence
  source: /note="Description of Artificial Sequence: Synthetic oligonucleotide"
  modified_base (6)..(6): a, c, t, g, unknown or other
aggtgntaatkw

SEQ ID NO: 765 - DNA, 12 bp, Artificial Sequence
  source: /note="Description of Artificial Sequence: Synthetic oligonucleotide"
  modified_base (6)..(6): a, c, t, g, unknown or other
aggtgntaattr

SEQ ID NO: 766 - DNA, 16 bp, Artificial Sequence
  source: /note="Description of Artificial Sequence: Synthetic oligonucleotide"
  modified_base (9)..(9): a, c, t, g, unknown or other
  modified_base (16)..(16): a, c, t, g, unknown or other
atttgcatnacaatrn

SEQ ID NO: 767 - DNA, 15 bp, Artificial Sequence
  source: /note="Description of Artificial Sequence: Synthetic oligonucleotide"
  modified_base (7)..(9): a, c, t, g, unknown or other
cacgtgnnngcgggy

SEQ ID NO: 768 - DNA, 20 bp, Artificial Sequence
  source: /note="Description of Artificial Sequence: Synthetic oligonucleotide"
  modified_base (7)..(11): a, c, t, g, unknown or other
  modified_base (19)..(20): a, c, t, g, unknown or other
cacgtgnnnnnsrggaarnn

SEQ ID NO: 769 - DNA, 16 bp, Artificial Sequence
  source: /note="Description of Artificial Sequence: Synthetic oligonucleotide"
  modified_base (7)..(9): a, c, t, g, unknown or other
  modified_base (16)..(16): a, c, t, g, unknown or other
cacgtgnnnrgattan

SEQ ID NO: 770 - DNA, 19 bp, Artificial Sequence
  source: /note="Description of Artificial Sequence: Synthetic oligonucleotide"
  modified_base (7)..(12): a, c, t, g, unknown or other
cagctgnnnnnncccgcay

SEQ ID NO: 771 - DNA, 13 bp, Artificial Sequence
  source: /note="Description of Artificial Sequence: Synthetic oligonucleotide"
  modified_base (13)..(13): a, c, t, g, unknown or other
cyaataaaatgyn

SEQ ID NO: 772 - DNA, 13 bp, Artificial Sequence
  source: /note="Description of Artificial Sequence: Synthetic oligonucleotide"
  modified_base (13)..(13): a, c, t, g, unknown or other
gtmaacaggawrn

SEQ ID NO: 773 - DNA, 14 bp, Artificial Sequence
  source: /note="Description of Artificial Sequence: Synthetic oligonucleotide"
  modified_base (14)..(14): a, c, t, g, unknown or other
gtmaataagggyrn

SEQ ID NO: 774 - DNA, 18 bp, Artificial Sequence
  source: /note="Description of Artificial Sequence: Synthetic oligonucleotide"
  modified_base (6)..(10): a, c, t, g, unknown or other
  modified_base (18)..(18): a, c, t, g, unknown or other
taatgnnnnncggaagtn

SEQ ID NO: 775 - DNA, 15 bp, Artificial Sequence
  source: /note="Description of Artificial Sequence: Synthetic oligonucleotide"
  modified_base (14)..(15): a, c, t, g, unknown or other
taatkrccggaagnn

SEQ ID NO: 776 - DNA, 17 bp, Artificial Sequence
  source: /note="Description of Artificial Sequence: Synthetic oligonucleotide"
  modified_base (7)..(10): a, c, t, g, unknown or other
  modified_base (17)..(17): a, c, t, g, unknown or other
taatkrnnnnggaagtn

SEQ ID NO: 777 - DNA, 18 bp, Artificial Sequence
  source: /note="Description of Artificial Sequence: Synthetic oligonucleotide"
  modified_base (7)..(11): a, c, t, g, unknown or other
  modified_base (18)..(18): a, c, t, g, unknown or other
taatkrnnnnnggaagtn

SEQ ID NO: 778 - DNA, 18 bp, Artificial Sequence
  source: /note="Description of Artificial Sequence: Synthetic oligonucleotide"
  modified_base (7)..(10): a, c, t, g, unknown or other
  modified_base (18)..(18): a, c, t, g, unknown or other
taattrnnnncggaaryn

SEQ ID NO: 779 - DNA, 17 bp, Artificial Sequence
  source: /note="Description of Artificial Sequence: Synthetic oligonucleotide"
  modified_base (7)..(9): a, c, t, g, unknown or other
  modified_base (17)..(17): a, c, t, g, unknown or other
tgacaknnnaacaatgn

SEQ ID NO: 780 - DNA, 14 bp, Artificial Sequence
  source: /note="Description of Artificial Sequence: Synthetic oligonucleotide"
  modified_base (6)..(8): a, c, t, g, unknown or other
tgacannntaatkr

SEQ ID NO: 781 - DNA, 12 bp, Artificial Sequence
  source: /note="Description of Artificial Sequence: Synthetic oligonucleotide"
tgacastaatkr

SEQ ID NO: 782 - DNA, 13 bp, Artificial Sequence
  source: /note="Description of Artificial Sequence: Synthetic oligonucleotide"
  modified_base (7)..(7): a, c, t, g, unknown or other
  modified_base (13)..(13): a, c, t, g, unknown or other
tgttgangcgggn

SEQ ID NO: 783 - DNA, 13 bp, Artificial Sequence
  source: /note="Description of Artificial Sequence: Synthetic oligonucleotide"
  modified_base (6)..(6): a, c, t, g, unknown or other
  modified_base (13)..(13): a, c, t, g, unknown or other
tgttgncggawrn

SEQ ID NO: 784 - DNA, 13 bp, Artificial Sequence
  source: /note="Description of Artificial Sequence: Synthetic oligonucleotide"
  modified_base (13)..(13): a, c, t, g, unknown or other
tgttkmcggawrn

SEQ ID NO: 785 - DNA, 14 bp, Artificial Sequence
  source: /note="Description of Artificial Sequence: Synthetic oligonucleotide"
  modified_base (13)..(14): a, c, t, g, unknown or other
tgttkmcggawrnn

SEQ ID NO: 786 - DNA, 13 bp, Artificial Sequence
  source: /note="Description of Artificial Sequence: Synthetic oligonucleotide"
  modified_base (2)..(2): a, c, t, g, unknown or other
  modified_base (13)..(13): a, c, t, g, unknown or other
tnrcaccggaagn

SEQ ID NO: 787 - DNA, 14 bp, Artificial Sequence
  source: /note="Description of Artificial Sequence: Synthetic oligonucleotide"
  modified_base (2)..(2): a, c, t, g, unknown or other
  modified_base (13)..(14): a, c, t, g, unknown or other
tnrcaccggaagnn

SEQ ID NO: 788 - DNA, 12 bp, Artificial Sequence
  source: /note="Description of Artificial Sequence: Synthetic oligonucleotide"
  modified_base (2)..(2): a, c, t, g, unknown or other
  modified_base (12)..(12): a, c, t, g, unknown or other
tnrcaccggawn

SEQ ID NO: 789 - DNA, 23 bp, Artificial Sequence
  source: /note="Description of Artificial Sequence: Synthetic oligonucleotide"
  modified_base (7)..(15): a, c, t, g, unknown or other
  modified_base (22)..(23): a, c, t, g, unknown or other
ttacgtnnnnnnnnnccggaann

SEQ ID NO: 790 - DNA, 18 bp, Artificial Sequence
  source: /note="Description of Artificial Sequence: Synthetic oligonucleotide"
  modified_base (10)..(12): a, c, t, g, unknown or other
accggaartnnnyaatta

SEQ ID NO: 791 - DNA, 16 bp, Artificial Sequence
  source: /note="Description of Artificial Sequence: Synthetic oligonucleotide"
  modified_base (6)..(6): a, c, t, g, unknown or other
aggtgngaarggatta

SEQ ID NO: 792 - DNA, 17 bp, Artificial Sequence
  source: /note="Description of Artificial Sequence: Synthetic oligonucleotide"
  modified_base (8)..(11): a, c, t, g, unknown or other
aggtgtgnnnnatcrat

SEQ ID NO: 793 - DNA, 19 bp, Artificial Sequence
  source: /note="Description of Artificial Sequence: Synthetic oligonucleotide"
  modified_base (2)..(2): a, c, t, g, unknown or other
  modified_base (9)..(14): a, c, t, g, unknown or other
anccggatnnnnnnmatta

SEQ ID NO: 794 - DNA, 16 bp, Artificial Sequence
  source: /note="Description of Artificial Sequence: Synthetic oligonucleotide"
  modified_base (6)..(11): a, c, t, g, unknown or other
argtgnnnnnnataaa

SEQ ID NO: 795 - DNA, 22 bp, Artificial Sequence
  source: /note="Description of Artificial Sequence: Synthetic oligonucleotide"
  modified_base (7)..(14): a, c, t, g, unknown or other
atcratnnnnnnnnsyattgtt

SEQ ID NO: 796 - DNA, 16 bp, Artificial Sequence
  source: /note="Description of Artificial Sequence: Synthetic oligonucleotide"
  modified_base (7)..(9): a, c, t, g, unknown or other
cacgtgnnntaatkat

SEQ ID NO: 797 - DNA, 23 bp, Artificial Sequence
  source: /note="Description of Artificial Sequence: Synthetic oligonucleotide"
  modified_base (7)..(17): a, c, t, g, unknown or other
casstgnnnnnnnnnnntgcggg

SEQ ID NO: 798 - DNA, 22 bp, Artificial Sequence
  source: /note="Description of Artificial Sequence: Synthetic oligonucleotide"
  modified_base (7)..(16): a, c, t, g, unknown or other
casstgnnnnnnnnnntgcggg

SEQ ID NO: 799 - DNA, 20 bp, Artificial Sequence
  source: /note="Description of Artificial Sequence: Synthetic oligonucleotide"
  modified_base (7)..(14): a, c, t, g, unknown or other
casstgnnnnnnnntgcggg

SEQ ID NO: 800 - DNA, 19 bp, Artificial Sequence
  source: /note="Description of Artificial Sequence: Synthetic oligonucleotide"
  modified_base (7)..(13): a, c, t, g, unknown or other
casstgnnnnnnntgcggg

SEQ ID NO: 801 - DNA, 15 bp, Artificial Sequence
  source: /note="Description of Artificial Sequence: Synthetic oligonucleotide"
  modified_base (9)..(10): a, c, t, g, unknown or other
cycataaanntgtca

SEQ ID NO: 802 - DNA, 14 bp, Artificial Sequence
  source: /note="Description of Artificial Sequence: Synthetic oligonucleotide"
  modified_base (7)..(8): a, c, t, g, unknown or other
ggaatknncasstg

SEQ ID NO: 803 - DNA, 14 bp, Artificial Sequence
  source: /note="Description of Artificial Sequence: Synthetic oligonucleotide"
  modified_base (7)..(9): a, c, t, g, unknown or other
ggwatgnnnrtaaa

SEQ ID NO: 804 - DNA, 14 bp, Artificial Sequence
  source: /note="Description of Artificial Sequence: Synthetic oligonucleotide"
  modified_base (7)..(9): a, c, t, g, unknown or other
ggwatgnnnrtaaa

SEQ ID NO: 805 - DNA, 24 bp, Artificial Sequence
  source: /note="Description of Artificial Sequence: Synthetic oligonucleotide"
  modified_base (7)..(18): a, c, t, g, unknown or other
gttgcynnnnnnnnnnnncasstg

SEQ ID NO: 806 - DNA, 17 bp, Artificial Sequence
  source: /note="Description of Artificial Sequence: Synthetic oligonucleotide"
  modified_base (8)..(9): a, c, t, g, unknown or other
gwmaacannsymrtaaa

SEQ ID NO: 807 - DNA, 14 bp, Artificial Sequence
  source: /note="Description of Artificial Sequence: Synthetic oligonucleotide"
gwmaacaymrtaaa

SEQ ID NO: 808 - DNA, 16 bp, Artificial Sequence
  source: /note="Description of Artificial Sequence: Synthetic oligonucleotide"
  modified_base (7)..(10): a, c, t, g, unknown or other
taatccnnnncasstg

SEQ ID NO: 809 - DNA, 13 bp, Artificial Sequence
  source: /note="Description of Artificial Sequence: Synthetic oligonucleotide"
  modified_base (11)..(11): a, c, t, g, unknown or other
taatkaggtgnka

SEQ ID NO: 810 - DNA, 14 bp, Artificial Sequence
  source: /note="Description of Artificial Sequence: Synthetic oligonucleotide"
  modified_base (7)..(8): a, c, t, g, unknown or other
taatkannggatta

SEQ ID NO: 811 - DNA, 13 bp, Artificial Sequence
  source: /note="Description of Artificial Sequence: Synthetic oligonucleotide"
taatkrggtgyka

SEQ ID NO: 812 - DNA, 13 bp, Artificial Sequence
  source: /note="Description of Artificial Sequence: Synthetic oligonucleotide"
taatkrggtgyka

SEQ ID NO: 813 - DNA, 12 bp, Artificial Sequence
  source: /note="Description of Artificial Sequence: Synthetic oligonucleotide"
tmacaccyaata

SEQ ID NO: 814 - DNA, 14 bp, Artificial Sequence
  source: /note="Description of Artificial Sequence: Synthetic oligonucleotide"
  modified_base (7)..(7): a, c, t, g, unknown or other
  modified_base (9)..(9): a, c, t, g, unknown or other
tttwatnrnmaaca

SEQ ID NO: 815 - DNA, 18 bp, Artificial Sequence
  source: /note="Description of Artificial Sequence: Synthetic oligonucleotide"
  modified_base (6)..(6): a, c, t, g, unknown or other
  modified_base (13)..(16): a, c, t, g, unknown or other
  modified_base (18)..(18): a, c, t, g, unknown or other
aggtgntaatkwnnnntn

SEQ ID NO: 816 - DNA, 14 bp, Artificial Sequence
  source: /note="Description of Artificial Sequence: Synthetic oligonucleotide"
  modified_base (8)..(8): a, c, t, g, unknown or other
aggtgtgncsgttr

SEQ ID NO: 817 - DNA, 15 bp, Artificial Sequence
  source: /note="Description of Artificial Sequence: Synthetic oligonucleotide"
  modified_base (7)..(9): a, c, t, g, unknown or other
  modified_base (15)..(15): a, c, t, g, unknown or other
aggtgtnnngsgggn

SEQ ID NO: 818 - DNA, 16 bp, Artificial Sequence
  source: /note="Description of Artificial Sequence: Synthetic oligonucleotide"
  modified_base (7)..(7): a, c, t, g, unknown or other
  modified_base (15)..(16): a, c, t, g, unknown or other
aggtgtnrtrcgggnn

SEQ ID NO: 819 - DNA, 13 bp, Artificial Sequence
  source: /note="Description of Artificial Sequence: Synthetic oligonucleotide"
  modified_base (2)..(2): a, c, t, g, unknown or other
angtgtgaatwcy

SEQ ID NO: 820 - DNA, 15 bp, Artificial Sequence
  source: /note="Description of Artificial Sequence: Synthetic oligonucleotide"
  modified_base (2)..(2): a, c, t, g, unknown or other
  modified_base (8)..(9): a, c, t, g, unknown or other
  modified_base (15)..(15): a, c, t, g, unknown or other
angtgtsnnataaan

SEQ ID NO: 821 - DNA, 21 bp, Artificial Sequence
  source: /note="Description of Artificial Sequence: Synthetic oligonucleotide"
  modified_base (9)..(13): a, c, t, g, unknown or other
  modified_base (20)..(21): a, c, t, g, unknown or other
atrcgggynnnnnywttgtnn

SEQ ID NO: 822 - DNA, 15 bp, Artificial Sequence
  source: /note="Description of Artificial Sequence: Synthetic oligonucleotide"
  modified_base (7)..(8): a, c, t, g, unknown or other
casstgnncccgcay

SEQ ID NO: 823 - DNA, 17 bp, Artificial Sequence
  source: /note="Description of Artificial Sequence: Synthetic oligonucleotide"
  modified_base (7)..(8): a, c, t, g, unknown or other
  modified_base (17)..(17): a, c, t, g, unknown or other
casstgnnccggawryn

SEQ ID NO: 824 - DNA, 17 bp, Artificial Sequence
  source: /note="Description of Artificial Sequence: Synthetic oligonucleotide"
  modified_base (7)..(7): a, c, t, g, unknown or other
  modified_base (9)..(10): a, c, t, g, unknown or other
  modified_base (16)..(17): a, c, t, g, unknown or other
casstgnrnnggaagnn

SEQ ID NO: 825 - DNA, 20 bp, Artificial Sequence
  source: /note="Description of Artificial Sequence: Synthetic oligonucleotide"
  modified_base (10)..(13): a, c, t, g, unknown or other
ctcrtaaawnnnnrmcgttr

SEQ ID NO: 826 - DNA, 16 bp, Artificial Sequence
  source: /note="Description of Artificial Sequence: Synthetic oligonucleotide"
  modified_base (7)..(8): a, c, t, g, unknown or other
  modified_base (16)..(16): a, c, t, g, unknown or other
ggattannargtgtkn

SEQ ID NO: 827 - DNA, 17 bp, Artificial Sequence
  source: /note="Description of Artificial Sequence: Synthetic oligonucleotide"
  modified_base (7)..(10): a, c, t, g, unknown or other
  modified_base (17)..(17): a, c, t, g, unknown or other
ggattannnnatcratn

SEQ ID NO: 828 - DNA, 19 bp, Artificial Sequence
  source: /note="Description of Artificial Sequence: Synthetic oligonucleotide"
  modified_base (7)..(12): a, c, t, g, unknown or other
  modified_base (19)..(19): a, c, t, g, unknown or other
ggwatgnnnnnncacgtgn

SEQ ID NO: 829 - DNA, 20 bp, Artificial Sequence
  source: /note="Description of Artificial Sequence: Synthetic oligonucleotide"
  modified_base (7)..(13): a, c, t, g, unknown or other
  modified_base (20)..(20): a, c, t, g, unknown or other
ggwatgnnnnnnncacgtgn

SEQ ID NO: 830 - DNA, 16 bp, Artificial Sequence
  source: /note="Description of Artificial Sequence: Synthetic oligonucleotide"
  modified_base (7)..(7): a, c, t, g, unknown or other
  modified_base (14)..(15): a, c, t, g, unknown or other
ggwatgnraggtgnnr

SEQ ID NO: 831 - DNA, 23 bp, Artificial Sequence
  source: /note="Description of Artificial Sequence: Synthetic oligonucleotide"
  modified_base (6)..(9): a, c, t, g, unknown or other
  modified_base (11)..(16): a, c, t, g, unknown or other
  modified_base (22)..(23): a, c, t, g, unknown or other
taatknnnngnnnnnncttccnn

SEQ ID NO: 832 - DNA, 14 bp, Artificial Sequence
  source: /note="Description of Artificial Sequence: Synthetic oligonucleotide"
  modified_base (14)..(14): a, c, t, g, unknown or other
taatkrscggawgn

SEQ ID NO: 833 - DNA, 16 bp, Artificial Sequence
  source: /note="Description of Artificial Sequence: Synthetic oligonucleotide"
  modified_base (7)..(7): a, c, t, g, unknown or other
tgacagnwaatcratr

SEQ ID NO: 834 - DNA, 13 bp, Artificial Sequence
  source: /note="Description of Artificial Sequence: Synthetic oligonucleotide"
  modified_base (13)..(13): a, c, t, g, unknown or other
tgttkatrcgggn

SEQ ID NO: 835 - DNA, 14 bp, Artificial Sequence
  source: /note="Description of Artificial Sequence: Synthetic oligonucleotide"
  modified_base (14)..(14): a, c, t, g, unknown or other
tgttkmcggawrtn

SEQ ID NO: 836 - DNA, 13 bp, Artificial Sequence
  source: /note="Description of Artificial Sequence: Synthetic oligonucleotide"
  modified_base (13)..(13): a, c, t, g, unknown or other
tmacacmggaarn

SEQ ID NO: 837 - DNA, 18 bp, Artificial Sequence
  source: /note="Description of Artificial Sequence: Synthetic oligonucleotide"
  modified_base (9)..(10): a, c, t, g, unknown or other
  modified_base (18)..(18): a, c, t, g, unknown or other
ttgcgyaannscggaagn

SEQ ID NO: 838 - DNA, 17 bp, Artificial Sequence
  source: /note="Description of Artificial Sequence: Synthetic oligonucleotide"
  modified_base (7)..(10): a, c, t, g, unknown or other
atcratnnnnycrtaaa

SEQ ID NO: 839 - DNA, 17 bp, Artificial Sequence
  source: /note="Description of Artificial Sequence: Synthetic oligonucleotide"
  modified_base (8)..(11): a, c, t, g, unknown or other
atratyannnncacgtg

SEQ ID NO: 840 - DNA, 14 bp, Artificial Sequence
  source: /note="Description of Artificial Sequence: Synthetic oligonucleotide"
ggwatgygtmaaca

SEQ ID NO: 841 - DNA, 14 bp, Artificial Sequence
  source: /note="Description of Artificial Sequence: Synthetic oligonucleotide"
tmacacyymrtwaa

SEQ ID NO: 842 - DNA, 14 bp, Artificial Sequence
  source: /note="Description of Artificial Sequence: Synthetic oligonucleotide"
tmrcacctcrtwaa

SEQ ID NO: 843 - DNA, 18 bp, Artificial Sequence
  source: /note="Description of Artificial Sequence: Synthetic oligonucleotide"
  modified_base (6)..(7): a, c, t, g, unknown or other
  modified_base (9)..(11): a, c, t, g, unknown or other
  modified_base (18)..(18): a, c, t, g, unknown or other
argtgnnannnmwtaaan

SEQ ID NO: 844 - DNA, 16 bp, Artificial Sequence
  source: /note="Description of Artificial Sequence: Synthetic oligonucleotide"
  modified_base (9)..(9): a, c, t, g, unknown or other
  modified_base (15)..(16): a, c, t, g, unknown or other
argtgtkantttatnn

SEQ ID NO: 845 - DNA, 20 bp, Artificial Sequence
  source: /note="Description of Artificial Sequence: Synthetic oligonucleotide"
  modified_base (9)..(13): a, c, t, g, unknown or other
argtgtkrnnnnnrgwatgy

SEQ ID NO: 846 - DNA, 13 bp, Artificial Sequence
  source: /note="Description of Artificial Sequence: Synthetic oligonucleotide"
  modified_base (13)..(13): a, c, t, g, unknown or other
cycrtaaatwccn

SEQ ID NO: 847 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
gtmaacannnnnatcratn

SEQ ID NO: 848 - DNA, 21 bp, Artificial Sequence
  source: /note="Description of Artificial Sequence: Synthetic oligonucleotide"
  modified_base (11)..(15): a, c, t, g, unknown or other
tgmatatkcannnnntaatkr

SEQ ID NO: 849 - DNA, 20 bp, Artificial Sequence
  source: /note="Description of Artificial Sequence: Synthetic oligonucleotide"
  modified_base (11)..(14): a, c, t, g, unknown or other
tgmatatkcannnntaatkr

SEQ ID NO: 850 - DNA, 21 bp, Artificial Sequence
  source: /note="Description of Artificial Sequence: Synthetic oligonucleotide"
  modified_base (2)..(2): a, c, t, g, unknown or other
  modified_base (6)..(8): a, c, t, g, unknown or other
  modified_base (12)..(14): a, c, t, g, unknown or other
  modified_base (21)..(21): a, c, t, g, unknown or other
tnsccnnnggsnnncacgtgn

SEQ ID NO: 851 - DNA, 22 bp, Artificial Sequence
  source: /note="Description of Artificial Sequence: Synthetic oligonucleotide"
  modified_base (2)..(2): a, c, t, g, unknown or other
  modified_base (6)..(8): a, c, t, g, unknown or other
  modified_base (12)..(15): a, c, t, g, unknown or other
  modified_base (22)..(22): a, c, t, g, unknown or other
tnsccnnnggsnnnncacgtgn

SEQ ID NO: 852 - DNA, 31 bp, Artificial Sequence
  source: /note="Description of Artificial Sequence: Synthetic oligonucleotide"
  modified_base (2)..(2): a, c, t, g, unknown or other
  modified_base (6)..(8): a, c, t, g, unknown or other
  modified_base (12)..(24): a, c, t, g, unknown or other
  modified_base (31)..(31): a, c, t, g, unknown or other
tnsccnnnggsnnnnnnnnnnnnncacgtgn

SEQ ID NO: 853 - DNA, 32 bp, Artificial Sequence
  source: /note="Description of Artificial Sequence: Synthetic oligonucleotide"
  modified_base (2)..(2): a, c, t, g, unknown or other
  modified_base (6)..(8): a, c, t, g, unknown or other
  modified_base (12)..(25): a, c, t, g, unknown or other
  modified_base (32)..(32): a, c, t, g, unknown or other
tnsccnnnggsnnnnnnnnnnnnnncacgtgn

SEQ ID NO: 854 - DNA, 14 bp, Artificial Sequence
  source: /note="Description of Artificial Sequence: Synthetic oligonucleotide"
tmrcacytmatwaa

SEQ ID NO: 855 - DNA, 29 bp, Artificial Sequence
  source: /note="Description of Artificial Sequence: Synthetic oligonucleotide"
  modified_base (2)..(2): a, c, t, g, unknown or other
  modified_base (6)..(7): a, c, t, g, unknown or other
  modified_base (9)..(19): a, c, t, g, unknown or other
  modified_base (21)..(22): a, c, t, g, unknown or other
  modified_base (28)..(29): a, c, t, g, unknown or other
angtgnnannnnnnnnnnncnnmggawnn

SEQ ID NO: 856 - DNA, 24 bp, Artificial Sequence
  source: /note="Description of Artificial Sequence: Synthetic oligonucleotide"
  modified_base (7)..(9): a, c, t, g, unknown or other
  modified_base (17)..(19): a, c, t, g, unknown or other
  modified_base (23)..(24): a, c, t, g, unknown or other
argtgtnnnaatatkynnncrcnn

SEQ ID NO: 857 - DNA, 20 bp, Artificial Sequence
  source: /note="Description of Artificial Sequence: Synthetic oligonucleotide"
  modified_base (8)..(11): a, c, t, g, unknown or other
  modified_base (20)..(20): a, c, t, g, unknown or other
atrsgggnnnnttrcgyaan

SEQ ID NO: 858 - DNA, 18 bp, Artificial Sequence
  source: /note="Description of Artificial Sequence: Synthetic oligonucleotide"
  modified_base (8)..(11): a, c, t, g, unknown or other
ggwatgynnnncrcgygy

SEQ ID NO: 859 - DNA, 20 bp, Artificial Sequence
  source: /note="Description of Artificial Sequence: Synthetic oligonucleotide"
  modified_base (8)..(13): a, c, t, g, unknown or other
ggwatgynnnnnncrcgygy

SEQ ID NO: 860 - DNA, 19 bp, Artificial Sequence
  source: /note="Description of Artificial Sequence: Synthetic oligonucleotide"
  modified_base (8)..(11): a, c, t, g, unknown or other
  modified_base (18)..(19): a, c, t, g, unknown or other
trgyaacnnnncasstgnn

SEQ ID NO: 861 - DNA, 30 bp, Artificial Sequence
  source: /note="Description of Artificial Sequence: Synthetic oligonucleotide"
  modified_base (9)..(23): a, c, t, g, unknown or other
aggygygannnnnnnnnnnnnnntcrtwaa

SEQ ID NO: 862 - DNA, 12 bp, Artificial Sequence
  source: /note="Description of Artificial Sequence: Synthetic oligonucleotide"
  modified_base (1)..(2): a, c, t, g, unknown or other
nncgtaaaatta

SEQ ID NO: 863 - DNA, 16 bp, Artificial Sequence
  source: /note="Description of Artificial Sequence: Synthetic oligonucleotide"
  modified_base (1)..(1): a, c, t, g, unknown or other
nrmatataccaataaa

SEQ ID NO: 864 - DNA, 12 bp, Artificial Sequence
  source: /note="Description of Artificial Sequence: Synthetic oligonucleotide"
  modified_base (1)..(1): a, c, t, g, unknown or other
ntcgtaaaatgc

SEQ ID NO: 865 - DNA, 11 bp, Artificial Sequence
  source: /note="Description of Artificial Sequence: Synthetic oligonucleotide"
  modified_base (1)..(1): a, c, t, g, unknown or other
ntcgtaaatca

SEQ ID NO: 866 - DNA, 14 bp, Artificial Sequence
  source: /note="Description of Artificial Sequence: Synthetic oligonucleotide"
rccggaagtaatta

SEQ ID NO: 867 - DNA, 15 bp, Artificial Sequence
  source: /note="Description of Artificial Sequence: Synthetic oligonucleotide"
  modified_base (2)..(3): a, c, t, g, unknown or other
ynnrtaaatcaatca

SEQ ID NO: 868 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nccggatatgcan

SEQ ID NO: 869 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nccggatatgcan

SEQ ID NO: 870 - DNA, 13 bp, Artificial Sequence
  source: /note="Description of Artificial Sequence: Synthetic oligonucleotide"
  modified_base (1)..(1): a, c, t, g, unknown or other
  modified_base (13)..(13): a, c, t, g, unknown or other
nccggatatgcan

SEQ ID NO: 871 - DNA, 14 bp, Artificial Sequence
  source: /note="Description of Artificial Sequence: Synthetic oligonucleotide"
  modified_base (1)..(1): a, c, t, g, unknown or other
  modified_base (13)..(14): a, c, t, g, unknown or other
ngatgatgcaatnn

SEQ ID NO: 872 - DNA, 17 bp, Artificial Sequence
  source: /note="Description of Artificial Sequence: Synthetic oligonucleotide"
  modified_base (1)..(1): a, c, t, g, unknown or other
  modified_base (17)..(17): a, c, t, g, unknown or other
ngcagctgccggawryn

SEQ ID NO: 873 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ngccacgcaayn

SEQ ID NO: 874 - DNA, 17 bp, Artificial Sequence
  source: /note="Description of Artificial Sequence: Synthetic oligonucleotide"
  modified_base (1)..(1): a, c, t, g, unknown or other
  modified_base (16)..(17): a, c, t, g, unknown or other
nmatgacacgcgccmnn

SEQ ID NO: 875 - DNA, 14 bp, Artificial Sequence
  source: /note="Description of Artificial Sequence: Synthetic oligonucleotide"
  modified_base (1)..(1): a, c, t, g, unknown or other
nmccggaaccgttr

SEQ ID NO: 876 - DNA, 17 bp, Artificial Sequence
  source: /note="Description of Artificial Sequence: Synthetic oligonucleotide"
  modified_base (1)..(2): a, c, t, g, unknown or other
  modified_base (17)..(17): a, c, t, g, unknown or other
nncagctgccggawryn

SEQ ID NO: 877 - DNA, 14 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
nngaaaaccgaanm

SEQ ID NO: 878 - DNA, 14 bp, Artificial Sequence
  source: /note="Description of Artificial Sequence: Synthetic oligonucleotide"
  modified_base (1)..(2): a, c, t, g, unknown or other
  modified_base (14)..(14): a, c, t, g, unknown or other
nnmatcacataaan

SEQ ID NO: 879 - DNA, 15 bp, Artificial Sequence
  source: /note="Description of Artificial Sequence: Synthetic oligonucleotide"
  modified_base (1)..(2): a, c, t, g, unknown or other
  modified_base (15)..(15): a, c, t, g, unknown or other
nnmcaccgcgcccmn

SEQ ID NO: 880 - DNA, 16 bp, Artificial Sequence
  source: /note="Description of Artificial Sequence: Synthetic oligonucleotide"
  modified_base (1)..(3): a, c, t, g, unknown or other
  modified_base (15)..(16): a, c, t, g, unknown or other
nnnrtaaatcacacnn

SEQ ID NO: 881 - DNA, 12 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ntgccggaagtn

SEQ ID NO: 882 - DNA, 14 bp, Artificial Sequence
  source: /note="Description of Artificial Sequence: Synthetic oligonucleotide"
  modified_base (1)..(1): a, c, t, g, unknown or other
  modified_base (13)..(14): a, c, t, g, unknown or other
nwaaacaggaagnn

SEQ ID NO: 883 - DNA, 12 bp, Artificial Sequence
  source: /note="Description of Artificial Sequence: Synthetic oligonucleotide"
rccggaaatrsy

SEQ ID NO: 884 - DNA, 13 bp, Artificial Sequence
  source: /note="Description of Artificial Sequence: Synthetic oligonucleotide"
  modified_base (13)..(13): a, c, t, g, unknown or other
rccggatgttkwn

SEQ ID NO: 885 - DNA, 13 bp, Artificial Sequence
  source: /note="Description of Artificial Sequence: Synthetic oligonucleotide"
rccggatgttkwy

SEQ ID NO: 886 - DNA, 14 bp, Artificial Sequence
  source: /note="Description of Artificial Sequence: Synthetic oligonucleotide"
  modified_base (14)..(14): a, c, t, g, unknown or other
rgaatgcggaagtn

SEQ ID NO: 887 - DNA, 14 bp, Artificial Sequence
  source: /note="Description of Artificial Sequence: Synthetic oligonucleotide"
rgaatgcggaagtr

SEQ ID NO: 888 - DNA, 12 bp, Artificial Sequence
  source: /note="Description of Artificial Sequence: Synthetic oligonucleotide"
  modified_base (12)..(12): a, c, t, g, unknown or other
rgaatgcggatn

SEQ ID NO: 889 - DNA, 12 bp, Artificial Sequence
  source: /note="Description of Artificial Sequence: Synthetic oligonucleotide"
  modified_base (12)..(12): a, c, t, g, unknown or other
rggtgttaatkn

SEQ ID NO: 890 - DNA, 15 bp, Artificial Sequence
  source: /note="Description of Artificial Sequence: Synthetic oligonucleotide"
  modified_base (14)..(15): a, c, t, g, unknown or other
rmagaaaaccgaann

SEQ ID NO: 891 - DNA, 13 bp, Artificial Sequence
  source: /note="Description of Artificial Sequence: Synthetic oligonucleotide"
  modified_base (2)..(2): a, c, t, g, unknown or other
  modified_base (13)..(13): a, c, t, g, unknown or other
rncggatgttkwn

SEQ ID NO: 892 - DNA, 13 bp, Artificial Sequence
  source: /note="Description of Artificial Sequence: Synthetic oligonucleotide"
  modified_base (2)..(2): a, c, t, g, unknown or other
  modified_base (13)..(13): a, c, t, g, unknown or other
rnmtgatgcaatn

SEQ ID NO: 893 - DNA, 16 bp, Artificial Sequence
  source: /note="Description of Artificial Sequence: Synthetic oligonucleotide"
  modified_base (16)..(16): a, c, t, g, unknown or other
rscggaagtaataaan

SEQ ID NO: 894 - DNA, 16 bp, Artificial Sequence
  source: /note="Description of Artificial Sequence: Synthetic oligonucleotide"
  modified_base (16)..(16): a, c, t, g, unknown or other
rscggaagtaataaan

SEQ ID NO: 895 - DNA, 16 bp, Artificial Sequence
  source: /note="Description of Artificial Sequence: Synthetic oligonucleotide"
  modified_base (16)..(16): a, c, t, g, unknown or other
rscggaagtaataaan

SEQ ID NO: 896 - DNA, 16 bp, Artificial Sequence
  source: /note="Description of Artificial Sequence: Synthetic oligonucleotide"
  modified_base (16)..(16): a, c, t, g, unknown or other
rscggaagtaataaan

SEQ ID NO: 897 - DNA, 16 bp, Artificial Sequence
  source: /note="Description of Artificial Sequence: Synthetic oligonucleotide"
  modified_base (16)..(16): a, c, t, g, unknown or other
rscggaagtcgtaaan

SEQ ID NO: 898 - DNA, 16 bp, Artificial Sequence
  source: /note="Description of Artificial Sequence: Synthetic oligonucleotide"
  modified_base (16)..(16): a, c, t, g, unknown or other
rscggaagtcgtaaan

SEQ ID NO: 899 - DNA, 12 bp, Artificial Sequence
  source: /note="Description of Artificial Sequence: Synthetic oligonucleotide"
  modified_base (12)..(12): a, c, t, g, unknown or other
rscggatgtkkn

SEQ ID NO: 900 - DNA, 12 bp, Artificial Sequence
  source: /note="Description of Artificial Sequence: Synthetic oligonucleotide"
  modified_base (12)..(12): a, c, t, g, unknown or other
rscggatgttgn

SEQ ID NO: 901 - DNA, 12 bp, Artificial Sequence
  source: /note="Description of Artificial Sequence: Synthetic oligonucleotide"
rscggatgttkw

SEQ ID NO: 902 - DNA, 13 bp, Artificial Sequence
  source: /note="Description of Artificial Sequence: Synthetic oligonucleotide"
  modified_base (13)..(13): a, c, t, g, unknown or other
rscggatgttkwn

SEQ ID NO: 903 - DNA, 11 bp, Artificial Sequence
  source: /note="Description of Artificial Sequence: Synthetic oligonucleotide"
rscggtaatkr

SEQ ID NO: 904 - DNA, 15 bp, Artificial Sequence
  source: /note="Description of Artificial Sequence: Synthetic oligonucleotide"
  modified_base (15)..(15): a, c, t, g, unknown or other
rtgcgggcggaagtn

SEQ ID NO: 905 - DNA, 15 bp, Artificial Sequence
  source: /note="Description of Artificial Sequence: Synthetic oligonucleotide"
  modified_base (15)..(15): a, c, t, g, unknown or other
rtgcgggcggaagtn

SEQ ID NO: 906 - DNA, 15 bp, Artificial Sequence
  source: /note="Description of Artificial Sequence: Synthetic oligonucleotide"
rtgcgggcggaagtr

SEQ ID NO: 907 - DNA, 15 bp, Artificial Sequence
  source: /note="Description of Artificial Sequence: Synthetic oligonucleotide"
  modified_base (15)..(15): a, c, t, g, unknown or other
rtgcgggtaataaan

SEQ ID NO: 908 - DNA, 14 bp, Artificial Sequence
  source: /note="Description of Artificial Sequence: Synthetic oligonucleotide"
  modified_base (14)..(14): a, c, t, g, unknown or other
rwmaacaggaagtn

SEQ ID NO: 909 - DNA, 14 bp, Artificial Sequence
  source: /note="Description of Artificial Sequence: Synthetic oligonucleotide"
  modified_base (13)..(14): a, c, t, g, unknown or other
rwmaacaggaarnn

SEQ ID NO: 910 - DNA, 14 bp, Artificial Sequence
  source: /note="Description of Artificial Sequence: Synthetic oligonucleotide"
  modified_base (14)..(14): a, c, t, g, unknown or other
rwyaacaggaagyn

SEQ ID NO: 911 - DNA, 12 bp, Artificial Sequence
  source: /note="Description of Artificial Sequence: Synthetic oligonucleotide"
  modified_base (12)..(12): a, c, t, g, unknown or other
sgcgctaattkn

SEQ ID NO: 912 - DNA, 11 bp, Artificial Sequence
  source: /note="Description of Artificial Sequence: Synthetic oligonucleotide"
waacaacacmy

SEQ ID NO: 913 - DNA, 13 bp, Artificial Sequence
  source: /note="Description of Artificial Sequence: Synthetic oligonucleotide"
  modified_base (12)..(12): a, c, t, g, unknown or other
wmscggatgtknw

SEQ ID NO: 914 - DNA, 17 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
ncacctgnnnnnmatta

SEQ ID NO: 915 - DNA, 15 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
ncacgtgnnggatta

SEQ ID NO: 916 - DNA, 17 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
ncaggtgnnnnnmatta

SEQ ID NO: 917 - DNA, 15 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
ncccgcannmataaa

SEQ ID NO: 918 - DNA, 16 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
ncccgcannnmrtaaa

SEQ ID NO: 919 - DNA, 20 bp, Artificial Sequence
  source: /note="Description of Artificial Sequence: Synthetic oligonucleotide"
  modified_base (1)..(1): a, c, t, g, unknown or other
  modified_base (9)..(14): a, c, t, g, unknown or other
nccggaagnnnnnnymatta

SEQ ID NO: 920 - DNA, 14 bp, Artificial Sequence
  source: /note="Description of Artificial Sequence: Synthetic oligonucleotide"
  modified_base (1)..(1): a, c, t, g, unknown or other
nccggaagtmatta

SEQ ID NO: 921 - DNA, 13 bp, Artificial Sequence
  source: /note="Description of Artificial Sequence: Synthetic oligonucleotide"
  modified_base (1)..(2): a, c, t, g, unknown or other
  modified_base (8)..(8): a, c, t, g, unknown or other
nnatcatngtaaa

SEQ ID NO: 922 - DNA, 12 bp, Artificial Sequence
  source: /note="Description of Artificial Sequence: Synthetic oligonucleotide"
  modified_base (1)..(2): a, c, t, g, unknown or other
nnatgaygcaat

SEQ ID NO: 923 - DNA, 14 bp, Artificial Sequence
  source: /note="Description of Artificial Sequence: Synthetic oligonucleotide"
  modified_base (1)..(2): a, c, t, g, unknown or other
  modified_base (9)..(9): a, c, t, g, unknown or other
nnmaacaynrtaaa

SEQ ID NO: 924 - DNA, 15 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
ntaatccnnwmaaca

SEQ ID NO: 925 - DNA, 11 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
nynatmaatca

SEQ ID NO: 926 - DNA, 19 bp, Artificial Sequence
  source: /note="Description of Artificial Sequence: Synthetic oligonucleotide"
  modified_base (8)..(13): a, c, t, g, unknown or other
rcattccnnnnnncacgtg

SEQ ID NO: 927 - DNA, 20 bp, Artificial Sequence
  source: /note="Description of Artificial Sequence: Synthetic oligonucleotide"
  modified_base (8)..(14): a, c, t, g, unknown or other
rcattccnnnnnnncacgtg

SEQ ID NO: 928 - DNA, 16 bp, Artificial Sequence
  source: /note="Description of Artificial Sequence: Synthetic oligonucleotide"
  modified_base (8)..(10): a, c, t, g, unknown or other
rcattccnnnyaatta

SEQ ID NO: 929 - DNA, 16 bp, Artificial Sequence
  source: /note="Description of Artificial Sequence: Synthetic oligonucleotide"
  modified_base (8)..(10): a, c, t, g, unknown or other
rcattccnnnymatta

SEQ ID NO: 930 - DNA, 17 bp, Artificial Sequence
  source: /note="Description of Artificial Sequence: Synthetic oligonucleotide"
  modified_base (7)..(12): a, c, t, g, unknown or other
rcattcnnnnnncatta

SEQ ID NO: 931 - DNA, 17 bp, Artificial Sequence
  source: /note="Description of Artificial Sequence: Synthetic oligonucleotide"
  modified_base (7)..(12): a, c, t, g, unknown or other
rcattcnnnnnncatta

SEQ ID NO: 932 - DNA, 17 bp, Artificial Sequence
  source: /note="Description of Artificial Sequence: Synthetic oligonucleotide"
  modified_base (7)..(11): a, c, t, g, unknown or other
rcattcnnnnntaatcc

SEQ ID NO: 933 - DNA, 16 bp, Artificial Sequence
  source: /note="Description of Artificial Sequence: Synthetic oligonucleotide"
  modified_base (8)..(10): a, c, t, g, unknown or other
rcattcynnncaatta

SEQ ID NO: 934 - DNA, 17 bp, Artificial Sequence
  source: /note="Description of Artificial Sequence: Synthetic oligonucleotide"
  modified_base (8)..(11): a, c, t, g, unknown or other
rcattcynnnncaatta

SEQ ID NO: 935 - DNA, 17 bp, Artificial Sequence
  source: /note="Description of Artificial Sequence: Synthetic oligonucleotide"
  modified_base (8)..(12): a, c, t, g, unknown or other
rcattcynnnnncatta

SEQ ID NO: 936 - DNA, 12 bp, Artificial Sequence
  source: /note="Description of Artificial Sequence: Synthetic oligonucleotide"
rccggaaatrcc

SEQ ID NO: 937 - DNA, 19 bp, Artificial Sequence
  source: /note="Description of Artificial Sequence: Synthetic oligonucleotide"
  modified_base (8)..(13): a, c, t, g, unknown or other
rccggaannnnnnyaatta

SEQ ID NO: 938 - DNA, 18 bp, Artificial Sequence
  source: /note="Description of Artificial Sequence: Synthetic oligonucleotide"
  modified_base (8)..(12): a, c, t, g, unknown or other
rccggaannnnnyaatta

SEQ ID NO: 939 - DNA, 13 bp, Artificial Sequence
  source: /note="Description of Artificial Sequence: Synthetic oligonucleotide"
rgaatgcggawrt

SEQ ID NO: 940 - DNA, 14 bp, Artificial Sequence
  source: /note="Description of Artificial Sequence: Synthetic oligonucleotide"
  modified_base (8)..(9): a, c, t, g, unknown or other
rgaatgcnnrtaaa

SEQ ID NO: 941 - DNA, 11 bp, Artificial Sequence
  source: /note="Description of Artificial Sequence: Synthetic oligonucleotide"
rgaatgygtga

SEQ ID NO: 942 - DNA, 14 bp, Artificial Sequence
  source: /note="Description of Artificial Sequence: Synthetic oligonucleotide"
  modified_base (8)..(9): a, c, t, g, unknown or other
rgaatgynnacgtg

SEQ ID NO: 943 - DNA, 21 bp, Artificial Sequence
  source: /note="Description of Artificial Sequence: Synthetic oligonucleotide"
  modified_base (7)..(15): a, c, t, g, unknown or other
rggtgtnnnnnnnnnyattgt

SEQ ID NO: 944 - DNA, 14 bp, Artificial Sequence
  source: /note="Description of Artificial Sequence: Synthetic oligonucleotide"
  modified_base (4)..(4): a, c, t, g, unknown or other
  modified_base (8)..(9): a, c, t, g, unknown or other
rkrngggnnataaa

SEQ ID NO: 945 - DNA, 14 bp, Artificial Sequence
  source: /note="Description of Artificial Sequence: Synthetic oligonucleotide"
  modified_base (2)..(2): a, c, t, g, unknown or other
  modified_base (8)..(9): a, c, t, g, unknown or other
rncggaannaaaca

SEQ ID NO: 946 - DNA, 13 bp, Artificial Sequence
  source: /note="Description of Artificial Sequence: Synthetic oligonucleotide"
rraatgcartaaa

SEQ ID NO: 947 - DNA, 12 bp, Artificial Sequence
  source: /note="Description of Artificial Sequence: Synthetic oligonucleotide"
rscggaaatrcc

SEQ ID NO: 948 - DNA, 14 bp, Artificial Sequence
  source: /note="Description of Artificial Sequence: Synthetic oligonucleotide"
rscggaagtmrtta

SEQ ID NO: 949 - DNA, 14 bp, Artificial Sequence
  source: /note="Description of Artificial Sequence: Synthetic oligonucleotide"
rscggaagtmrtta

SEQ ID NO: 950 - DNA, 17 bp, Artificial Sequence
  source: /note="Description of Artificial Sequence: Synthetic oligonucleotide"
  modified_base (8)..(11): a, c, t, g, unknown or other
rscggaannnnggatta

SEQ ID NO: 951 - DNA, 18 bp, Artificial Sequence
  source: /note="Description of Artificial Sequence: Synthetic oligonucleotide"
  modified_base (8)..(12): a, c, t, g, unknown or other
rscggaannnnnggatta

SEQ ID NO: 952 - DNA, 20 bp, Artificial Sequence
  source: /note="Description of Artificial Sequence: Synthetic oligonucleotide"
  modified_base (8)..(14): a, c, t, g, unknown or other
rscggaannnnnnnywttgt

SEQ ID NO: 953 - DNA, 19 bp, Artificial Sequence
  source: /note="Description of Artificial Sequence: Synthetic oligonucleotide"
  modified_base (8)..(13): a, c, t, g, unknown or other
rscggaannnnnnrtcgat

SEQ ID NO: 954 - DNA, 19 bp, Artificial Sequence
  source: /note="Description of Artificial Sequence: Synthetic oligonucleotide"
  modified_base (8)..(13): a, c, t, g, unknown or other
rscggaannnnnnyaatta

SEQ ID NO: 955 - DNA, 19 bp, Artificial Sequence
  source: /note="Description of Artificial Sequence: Synthetic oligonucleotide"
  modified_base (8)..(13): a, c, t, g, unknown or other
rscggaannnnnnywttgt

SEQ ID NO: 956 - DNA, 18 bp, Artificial Sequence
  source: /note="Description of Artificial Sequence: Synthetic oligonucleotide"
  modified_base (8)..(12): a, c, t, g, unknown or other
rscggaannnnnyaatta

SEQ ID NO: 957 - DNA, 18 bp, Artificial Sequence
  source: /note="Description of Artificial Sequence: Synthetic oligonucleotide"
  modified_base (8)..(12): a, c, t, g, unknown or other
rscggaannnnnyaatta

SEQ ID NO: 958 - DNA, 18 bp, Artificial Sequence
  source: /note="Description of Artificial Sequence: Synthetic oligonucleotide"
  modified_base (8)..(12): a, c, t, g, unknown or other
rscggaannnnnyaatta

SEQ ID NO: 959 - DNA, 18 bp, Artificial Sequence
  source: /note="Description of Artificial Sequence: Synthetic oligonucleotide"
  modified_base (8)..(12): a, c, t, g, unknown or other
rscggaannnnnymatta

SEQ ID NO: 960 - DNA, 17 bp, Artificial Sequence
  source: /note="Description of Artificial Sequence: Synthetic oligonucleotide"
  modified_base (8)..(11): a, c, t, g, unknown or other
rscggaannnnyaatta

SEQ ID NO: 961 - DNA, 14 bp, Artificial Sequence
  source: /note="Description of Artificial Sequence: Synthetic oligonucleotide"
  modified_base (8)..(8): a, c, t, g, unknown or other
rscggaanyaatta

SEQ ID NO: 962 - DNA, 15 bp, Artificial Sequence
  source: /note="Description of Artificial Sequence: Synthetic oligonucleotide"
  modified_base (8)..(8): a, c, t, g, unknown or other
  modified_base (10)..(10): a, c, t, g, unknown or other
rscggaanynrtaaa

SEQ ID NO: 963 - DNA, 14 bp, Artificial Sequence
  source: /note="Description of Artificial Sequence: Synthetic oligonucleotide"
rscggaaryaatta

SEQ ID NO: 964 - DNA, 20 bp, Artificial Sequence
  source: /note="Description of Artificial Sequence: Synthetic oligonucleotide"
  modified_base (8)..(14): a, c, t, g, unknown or other
rscggawnnnnnnnymatta

SEQ ID NO: 965 - DNA, 13 bp, Artificial Sequence
  source: /note="Description of Artificial Sequence: Synthetic oligonucleotide"
rscggawryatta

SEQ ID NO: 966 - DNA, 13 bp, Artificial Sequence
  source: /note="Description of Artificial Sequence: Synthetic oligonucleotide"
smggaagtmrtta

SEQ ID NO: 967 - DNA, 15 bp, Artificial Sequence
  source: /note="Description of Artificial Sequence: Synthetic oligonucleotide"
  modified_base (9)..(9): a, c, t, g, unknown or other
symrtaaanctgtca

SEQ ID NO: 968 - DNA, 15 bp, Artificial Sequence
  source: /note="Description of Artificial Sequence: Synthetic oligonucleotide"
  modified_base (3)..(3): a, c, t, g, unknown or other
  modified_base (9)..(10): a, c, t, g, unknown or other
synrtaaanntgtca

SEQ ID NO: 969 - DNA, 22 bp, Artificial Sequence
  source: /note="Description of Artificial Sequence: Synthetic oligonucleotide"
  modified_base (7)..(16): a, c, t, g, unknown or other
yaacggnnnnnnnnnncacgtg

SEQ ID NO: 970 - DNA, 23 bp, Artificial Sequence
  source: /note="Description of Artificial Sequence: Synthetic oligonucleotide"
  modified_base (7)..(17): a, c, t, g, unknown or other
yaacggnnnnnnnnnnncacgtg

SEQ ID NO: 971 - DNA, 19 bp, Artificial Sequence
  source: /note="Description of Artificial Sequence: Synthetic oligonucleotide"
  modified_base (7)..(13): a, c, t, g, unknown or other
yrattannnnnnncacgtg

SEQ ID NO: 972 - DNA, 17 bp, Artificial Sequence
  source: /note="Description of Artificial Sequence: Synthetic oligonucleotide"
  modified_base (1)..(1): a, c, t, g, unknown or other
  modified_base (8)..(11): a, c, t, g, unknown or other
nacaatrnnnngaatgy

SEQ ID NO: 973 - DNA, 18 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
nacaatrnnnnngaatgy

SEQ ID NO: 974 - DNA, 21 bp, Artificial Sequence
  source: /note="Description of Artificial Sequence: Synthetic oligonucleotide"
  modified_base (1)..(1): a, c, t, g, unknown or other
  modified_base (11)..(14): a, c, t, g, unknown or other
  modified_base (21)..(21): a, c, t, g, unknown or other
nacttccggynnnngcaacsn

SEQ ID NO: 975 - DNA, 13 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
naggtgntaatkr

SEQ ID NO: 976 - DNA, 19 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(19): a, c, t, g, unknown or other
ncacgtgnnnnncatatgn

SEQ ID NO: 977 - DNA, 20 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (20)..(20): a, c, t, g, unknown or other
ncacgtgnnnnnscggawrn

SEQ ID NO: 978 - DNA, 19 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(19): a, c, t, g, unknown or other
ncagctgnnnnncacgtgn

SEQ ID NO: 979 - DNA, 21 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
  modified_base (21)..(21): a, c, t, g, unknown or other
ncagctgnnnnnnncacgtgn

SEQ ID NO: 980 - DNA, 16 bp, Artificial Sequence
  source: /note="Description of Artificial Sequence: Synthetic oligonucleotide"
  modified_base (1)..(1): a, c, t, g, unknown or other
  modified_base (16)..(16): a, c, t, g, unknown or other
nccggaagtyrtaaan

SEQ ID NO: 981 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
nccggaancatatgn

SEQ ID NO: 982 - DNA, 21 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
  modified_base (20)..(21): a, c, t, g, unknown or other
nccggaannnnnncagctgnn

SEQ ID NO: 983 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
nccggaanyataaan

SEQ ID NO: 984 - DNA, 24 bp, Artificial Sequence
  source: /note="Description of Artificial Sequence: Synthetic oligonucleotide"
  modified_base (1)..(1): a, c, t, g, unknown or other
  modified_base (7)..(17): a, c, t, g, unknown or other
  modified_base (24)..(24): a, c, t, g, unknown or other
nccggwnnnnnnnnnnnscattan

SEQ ID NO: 985 - DNA, 16 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
  modified_base (16)..(16): a, c, t, g, unknown or other
nggtgtgnnggcgcsn

SEQ ID NO: 986 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
nggtgtgnnnggcgcsn

SEQ ID NO: 987 - DNA, 30 bp, Artificial Sequence
  source: /note="Description of Artificial Sequence: Synthetic oligonucleotide"
  modified_base (1)..(1): a, c, t, g, unknown or other
  modified_base (7)..(21): a, c, t, g, unknown or other
  modified_base (28)..(30): a, c, t, g, unknown or other
nggtgtnnnnnnnnnnnnnnnccggawnnn

SEQ ID NO: 988 - DNA, 18 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
  modified_base (17)..(18): a, c, t, g, unknown or other
nmatgacacngcgccmnn

SEQ ID NO: 989 - DNA, 19 bp, Artificial Sequence
  source: /note="Description of Artificial Sequence: Synthetic oligonucleotide"
  modified_base (1)..(2): a, c, t, g, unknown or other
  modified_base (8)..(13): a, c, t, g, unknown or other
nnacaatnnnnnngaatgy

SEQ ID NO: 990 - DNA, 16 bp, Artificial Sequence
  source: /note="Description of Artificial Sequence: Synthetic oligonucleotide"
  modified_base (1)..(2): a, c, t, g, unknown or other
  modified_base (16)..(16): a, c, t, g, unknown or other
nnaraaaaccgaawmn

SEQ ID NO: 991 - DNA, 13 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
nnatgaygcaayn

SEQ ID NO: 992 - DNA, 18 bp, Artificial Sequence
  source: /note="Description of Artificial Sequence: Synthetic oligonucleotide"
  modified_base (1)..(2): a, c, t, g, unknown or other
  modified_base (17)..(18): a, c, t, g, unknown or other
nncacgtgacmggaarnn

SEQ ID NO: 993 - DNA, 18 bp, Artificial Sequence
  source: /note="Description of Artificial Sequence: Synthetic oligonucleotide"
  modified_base (1)..(2): a, c, t, g, unknown or other
  modified_base (9)..(11): a, c, t, g, unknown or other
  modified_base (18)..(18): a, c, t, g, unknown or other
nncacgtgnnngcgggyn

SEQ ID NO: 994 - DNA, 20 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
  modified_base (19)..(20): a, c, t, g, unknown or other
nncacgtgnnnnccggaann

SEQ ID NO: 995 - DNA, 20 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
  modified_base (19)..(20): a, c, t, g, unknown or other
nncacgtgnnnnccggaann

SEQ ID NO: 996 - DNA, 21 bp, Artificial Sequence
  source: /note="Description of Artificial Sequence: Synthetic oligonucleotide"
  modified_base (1)..(2): a, c, t, g, unknown or other
  modified_base (9)..(13): a, c, t, g, unknown or other
  modified_base (20)..(21): a, c, t, g, unknown or other
nncacgtgnnnnnccggaann

SEQ ID NO: 997 - DNA, 21 bp, Artificial Sequence
  source: /note="Description of Artificial Sequence: Synthetic oligonucleotide"
  modified_base (1)..(2): a, c, t, g, unknown or other
  modified_base (9)..(13): a, c, t, g, unknown or other
nncacgtgnnnnnccggawry

SEQ ID NO: 998 - DNA, 20 bp, Artificial Sequence
  source: /note="Description of Artificial Sequence: Synthetic oligonucleotide"
  modified_base (1)..(2): a, c, t, g, unknown or other
  modified_base (9)..(13): a, c, t, g, unknown or other
nncacgtgnnnnncggawry

SEQ ID NO: 999 - DNA, 28 bp, Artificial Sequence
  source: /note="Description of Artificial Sequence: Synthetic oligonucleotide"
  modified_base (1)..(2): a, c, t, g, unknown or other
  modified_base (9)..(18): a, c, t, g, unknown or other
  modified_base (28)..(28): a, c, t, g, unknown or other
nncacgtgnnnnnnnnnnrtgcgggyrn

SEQ ID NO: 1000 - DNA, 22 bp, Artificial Sequence
  source: /note="Description of Artificial Sequence: Synthetic oligonucleotide"
  modified_base (1)..(2): a, c, t, g, unknown or other
  modified_base (9)..(14): a, c, t, g, unknown or other
  modified_base (21)..(22): a, c, t, g, unknown or other
nncagctgnnnnnncacgtgnn

SEQ ID NO: 1001 - DNA, 23 bp, Artificial Sequence
  source: /note="Description of Artificial Sequence: Synthetic oligonucleotide"
  modified_base (1)..(2): a, c, t, g, unknown or other
  modified_base (9)..(16): a, c, t, g, unknown or other
  modified_base (23)..(23): a, c, t, g, unknown or other
nncagctgnnnnnnnnatcgatn

SEQ ID NO: 1002 - DNA, 21 bp, Artificial Sequence
  source: /note="Description of Artificial Sequence: Synthetic oligonucleotide"
  modified_base (1)..(2): a, c, t, g, unknown or other
  modified_base (9)..(15): a, c, t, g, unknown or other
  modified_base (21)..(21): a, c, t, g, unknown or other
nncagctgnnnnnnntaattn

SEQ ID NO: 1003 - DNA, 18 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
nncagctgnnnntaatkr

SEQ ID NO: 1004 - DNA, 22 bp, Artificial Sequence
  source: /note="Description of Artificial Sequence: Synthetic oligonucleotide"
  modified_base (1)..(2): a, c, t, g, unknown or other
  modified_base (9)..(13): a, c, t, g, unknown or other
  modified_base (22)..(22): a, c, t, g, unknown or other
nncaggtgnnnnnmcggaaryn

SEQ ID NO: 1005 - DNA, 16 bp, Artificial Sequence
  source: /note="Description of Artificial Sequence: Synthetic oligonucleotide"
  modified_base (1)..(2): a, c, t, g, unknown or other
  modified_base (8)..(8): a, c, t, g, unknown or other
  modified_base (15)..(16): a, c, t, g, unknown or other
nncggaancaggtgnn

SEQ ID NO: 1006 - DNA, 19 bp, Artificial Sequence
  source: /note="Description of Artificial Sequence: Synthetic oligonucleotide"
  modified_base (1)..(2): a, c, t, g, unknown or other
  modified_base (8)..(10): a, c, t, g, unknown or other
  modified_base (17)..(19): a, c, t, g, unknown or other
nngattannnatgcawnnn

SEQ ID NO: 1007 - DNA, 17 bp, Artificial Sequence
  source: /note="Description of Artificial Sequence: Synthetic oligonucleotide"
  modified_base (1)..(2): a, c, t, g, unknown or other
  modified_base (10)..(11): a, c, t, g, unknown or other
  modified_base (17)..(17): a, c, t, g, unknown or other
nngtcacgcnncattan

SEQ ID NO: 1008 - DNA, 17 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
  modified_base (16)..(17): a, c, t, g, unknown or other
nngtcacgnntcattnn

SEQ ID NO: 1009 - DNA, 16 bp, Artificial Sequence
  source: /note="Description of Artificial Sequence: Synthetic oligonucleotide"
  modified_base (1)..(2): a, c, t, g, unknown or other
  modified_base (9)..(10): a, c, t, g, unknown or other
  modified_base (16)..(16): a, c, t, g, unknown or other
nnmggaarnnrtaaan

SEQ ID NO: 1010 - DNA, 20 bp, Artificial Sequence
  source: /note="Description of Artificial Sequence: Synthetic oligonucleotide"
  modified_base (1)..(3): a, c, t, g, unknown or other
  modified_base (8)..(13): a, c, t, g, unknown or other
  modified_base (18)..(20): a, c, t, g, unknown or other
nnnacgannnnnntcgtnnn

SEQ ID NO: 1011 - DNA, 17 bp, Artificial Sequence
  source: /note="Description of Artificial Sequence: Synthetic oligonucleotide"
  modified_base (1)..(3): a, c, t, g, unknown or other
  modified_base (8)..(10): a, c, t, g, unknown or other
  modified_base (16)..(17): a, c, t, g, unknown or other
nnncgggnnnggtgtnn

SEQ ID NO: 1012 - DNA, 16 bp, Artificial Sequence
  source: /note="Description of Artificial Sequence: Synthetic oligonucleotide"
  modified_base (1)..(3): a, c, t, g, unknown or other
  modified_base (16)..(16): a, c, t, g, unknown or other
nnngmataacaawrrn

SEQ ID NO: 1013 - DNA, 22 bp, Artificial Sequence
  source: /note="Description of Artificial Sequence: Synthetic oligonucleotide"
  modified_base (1)..(4): a, c, t, g, unknown or other
  modified_base (10)..(14): a, c, t, g, unknown or other
  modified_base (21)..(22): a, c, t, g, unknown or other
nnnngcgcsnnnnncacgtgnn

SEQ ID NO: 1014 - DNA, 14 bp, Artificial Sequence
  source: /note="Description of Artificial Sequence: Synthetic oligonucleotide"
  modified_base (1)..(3): a, c, t, g, unknown or other
  modified_base (9)..(9): a, c, t, g, unknown or other
  modified_base (14)..(14): a, c, t, g, unknown or other
nnnrtaaanctgtn

SEQ ID NO: 1015 - DNA, 20 bp, Artificial Sequence
  source: /note="Description of Artificial Sequence: Synthetic oligonucleotide"
  modified_base (1)..(3): a, c, t, g, unknown or other
  modified_base (10)..(13): a, c, t, g, unknown or other
  modified_base (19)..(20): a, c, t, g, unknown or other
nnnttccgsnnnngcaacnn

SEQ ID NO: 1016 - DNA, 15 bp, Artificial Sequence
  source: /note="Description of Artificial Sequence: Synthetic oligonucleotide"
  modified_base (1)..(2): a, c, t, g, unknown or other
  modified_base (4)..(4): a, c, t, g, unknown or other
  modified_base (15)..(15): a, c, t, g, unknown or other
nnrngggcggaartn

SEQ ID NO: 1017 - DNA, 18 bp, Artificial Sequence
  source: /note="Description of Artificial Sequence: Synthetic oligonucleotide"
  modified_base (1)..(2): a, c, t, g, unknown or other
  modified_base (9)..(11): a, c, t, g, unknown or other
  modified_base (18)..(18): a, c, t, g, unknown or other
nnsgcgcsnnnatcgayn

SEQ ID NO: 1018 - DNA, 19 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
  modified_base (19)..(19): a, c, t, g, unknown or other
nnsgcgcsnnnnatcgayn

SEQ ID NO: 1019 - DNA, 20 bp, Artificial Sequence
  source: /note="Description of Artificial Sequence: Synthetic oligonucleotide"
  modified_base (1)..(2): a, c, t, g, unknown or other
  modified_base (13)..(13): a, c, t, g, unknown or other
  modified_base (19)..(20): a, c, t, g, unknown or other
nnsmggacggayntccksnn

SEQ ID NO: 1020 - DNA, 22 bp, Artificial Sequence
  source: /note="Description of Artificial Sequence: Synthetic oligonucleotide"
  modified_base (1)..(2): a, c, t, g, unknown or other
  modified_base (9)..(15): a, c, t, g, unknown or other
  modified_base (21)..(22): a, c, t, g, unknown or other
nnymattannnnnnnggaagnn

SEQ ID NO: 1021 - DNA, 21 bp, Artificial Sequence
  source: /note="Description of Artificial Sequence: Synthetic oligonucleotide"
  modified_base (1)..(1): a, c, t, g, unknown or other
  modified_base (9)..(13): a, c, t, g, unknown or other
  modified_base (20)..(21): a, c, t, g, unknown or other
nrcagctgnnnnncacgtgnn

SEQ ID NO: 1022 - DNA, 19 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(19): a, c, t, g, unknown or other
nrcattcnnnnntaattrn

SEQ ID NO: 1023 - DNA, 17 bp, Artificial Sequence
  source: /note="Description of Artificial Sequence: Synthetic oligonucleotide"
  modified_base (1)..(1): a, c, t, g, unknown or other
  modified_base (8)..(11): a, c, t, g, unknown or other
  modified_base (17)..(17): a, c, t, g, unknown or other
nrcattcnnnnyaattn

SEQ ID NO: 1024 - DNA, 16 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
  modified_base (15)..(16): a, c, t, g, unknown or other
nrcccrnncggaagnn

SEQ ID NO: 1025 - DNA, 17 bp, Artificial Sequence
  source: /note="Description of Artificial Sequence: Synthetic oligonucleotide"
  modified_base (1)..(1): a, c, t, g, unknown or other
  modified_base (10)..(11): a, c, t, g, unknown or other
  modified_base (17)..(17): a, c, t, g, unknown or other
nrscggaagnngtaaan

SEQ ID NO: 1026 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (16)..(17): a, c, t, g, unknown or other
nscggaarncacgtgnn

SEQ ID NO: 1027 - DNA, 19 bp, Artificial Sequence
  source: /note="Description of Artificial Sequence: Synthetic oligonucleotide"
  modified_base (1)..(1): a, c, t, g, unknown or other
  modified_base (9)..(13): a, c, t, g, unknown or other
  modified_base (19)..(19): a, c, t, g, unknown or other
nscggaarnnnnnmattan

SEQ ID NO: 1028 - DNA, 20 bp, Artificial Sequence
  source: /note="Description of Artificial Sequence: Synthetic oligonucleotide"
  modified_base (1)..(1): a, c, t, g, unknown or other
  modified_base (9)..(14): a, c, t, g, unknown or other
  modified_base (20)..(20): a, c, t, g, unknown or other
nscggaarnnnnnnmattan

SEQ ID NO: 1029 - DNA, 22 bp, Artificial Sequence
  source: /note="Description of Artificial Sequence: Synthetic oligonucleotide"
  modified_base (1)..(1): a, c, t, g, unknown or other
  modified_base (9)..(14): a, c, t, g, unknown or other
  modified_base (21)..(22): a, c, t, g, unknown or other
nscggaarnnnnnntcacacnn

SEQ ID NO: 1030 - DNA, 21 bp, Artificial Sequence
  source: /note="Description of Artificial Sequence: Synthetic oligonucleotide"
  modified_base (1)..(1): a, c, t, g, unknown or other
  modified_base (9)..(13): a, c, t, g, unknown or other
  modified_base (20)..(21): a, c, t, g, unknown or other
nscggaarnnnnntcacacnn

SEQ ID NO: 1031 - DNA, 17 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (17)..(17): a, c, t, g, unknown or other
nscggawnttacgtaan

SEQ ID NO: 1032 - DNA, 18 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
  modified_base (18)..(18): a, c, t, g, unknown or other
nsmggacggayntccksn

SEQ ID NO: 1033 - DNA, 18 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
  modified_base (18)..(18): a, c, t, g, unknown or other
nsmggacggayntccksn

SEQ ID NO: 1034 - DNA, 18 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
  modified_base (18)..(18): a, c, t, g, unknown or other
nsmggacggayntccksn

SEQ ID NO: 1035 - DNA, 18 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
  modified_base (18)..(18): a, c, t, g, unknown or other
nsmggacggayntccksn

SEQ ID NO: 1036 - DNA, 16 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (16)..(16): a, c, t, g, unknown or other
ntaatkrsnmrtaaan

SEQ ID NO: 1037 - DNA, 17 bp, Artificial Sequence
  source: /note="Description of Artificial Sequence: Synthetic oligonucleotide"
  modified_base (1)..(1): a, c, t, g, unknown or other
  modified_base (6)..(6): a, c, t, g, unknown or other
  modified_base (9)..(9): a, c, t, g, unknown or other
  modified_base (17)..(17): a, c, t, g, unknown or other
ntaatnrsnymrtaaan

SEQ ID NO: 1038 - DNA, 19 bp, Artificial Sequence
  source: /note="Description of Artificial Sequence: Synthetic oligonucleotide"
  modified_base (1)..(1): a, c, t, g, unknown or other
  modified_base (7)..(12): a, c, t, g, unknown or other
  modified_base (19)..(19): a, c, t, g, unknown or other
ntgacrnnnnnncacgtgn

SEQ ID NO: 1039 - DNA, 14 bp, Artificial Sequence
  source: /note="Description of Artificial Sequence: Synthetic oligonucleotide"
  modified_base (1)..(1): a, c, t, g, unknown or other
  modified_base (10)..(10): a, c, t, g, unknown or other
  modified_base (14)..(14): a, c, t, g, unknown or other
ntgttgatrngggn

SEQ ID NO: 1040 - DNA, 15 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (14)..(15): a, c, t, g, unknown or other
ntgttgncggaarnn

SEQ ID NO: 1041 - DNA, 17 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
  modified_base (16)..(17): a, c, t, g, unknown or other
ntttaynnccggaarnn

SEQ ID NO: 1042 - DNA, 18 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
nymattannnnnacaatr

SEQ ID NO: 1043 - DNA, 20 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(20): a, c, t, g, unknown or other
nymattannnnncagctgnn

SEQ ID NO: 1044 - DNA, 19 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
nymattannnnnnacaatr

SEQ ID NO: 1045 - DNA, 21 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
  modified_base (20)..(21): a, c, t, g, unknown or other
nymattannnnnncagctgnn

SEQ ID NO: 1046 - DNA, 22 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
  modified_base (21)..(22): a, c, t, g, unknown or other
nymattannnnnnncagctgnn

SEQ ID NO: 1047 - DNA, 22 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
  modified_base (21)..(22): a, c, t, g, unknown or other
nymattannnnnnnnggaagnn

SEQ ID NO: 1048 - DNA, 31 bp, Artificial Sequence
  source: /note="Description of Artificial Sequence: Synthetic oligonucleotide"
  modified_base (8)..(23): a, c, t, g, unknown or other
  modified_base (31)..(31): a, c, t, g, unknown or other
raggtsrnnnnnnnnnnnnnnnncggaagyn

SEQ ID NO: 1049 - DNA, 16 bp, Artificial Sequence
  source: /note="Description of Artificial Sequence: Synthetic oligonucleotide"
  modified_base (8)..(9): a, c, t, g, unknown or other
  modified_base (16)..(16): a, c, t, g, unknown or other
rcattccnnatcgayn

SEQ ID NO: 1050 - DNA, 17 bp, Artificial Sequence
  source: /note="Description of Artificial Sequence: Synthetic oligonucleotide"
  modified_base (8)..(11): a, c, t, g, unknown or other
rcattccnnnntaatkr

SEQ ID NO: 1051 - DNA, 28 bp, Artificial Sequence
  source: /note="Description of Artificial Sequence: Synthetic oligonucleotide"
  modified_base (7)..(22): a, c, t, g, unknown or other
  modified_base (28)..(28): a, c, t, g, unknown or other
rcattcnnnnnnnnnnnnnnnngcaacn

SEQ ID NO: 1052 - DNA, 29 bp, Artificial Sequence
  source: /note="Description of Artificial Sequence: Synthetic oligonucleotide"
  modified_base (7)..(23): a, c, t, g, unknown or other
  modified_base (29)..(29): a, c, t, g, unknown or other
rcattcnnnnnnnnnnnnnnnnngcaacn

SEQ ID NO: 1053 - DNA, 17 bp, Artificial Sequence
  source: /note="Description of Artificial Sequence: Synthetic oligonucleotide"
  modified_base (7)..(11): a, c, t, g, unknown or other
rcattcnnnnntaatkr

SEQ ID NO: 1054 - DNA, 20 bp, Artificial Sequence
  source: /note="Description of Artificial Sequence: Synthetic oligonucleotide"
  modified_base (8)..(11): a, c, t, g, unknown or other
  modified_base (20)..(20): a, c, t, g, unknown or other
rcattcynnnncaaggtcan

SEQ ID NO: 1055 - DNA, 17 bp, Artificial Sequence
  source: /note="Description of Artificial Sequence: Synthetic oligonucleotide"
  modified_base (8)..(11): a, c, t, g, unknown or other
rcattcynnnntaattr

SEQ ID NO: 1056 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
rccggaannnnnatcgatn

SEQ ID NO: 1057 - DNA, 20 bp, Artificial Sequence
  source: /note="Description of Artificial Sequence: Synthetic oligonucleotide"
  modified_base (8)..(13): a, c, t, g, unknown or other
  modified_base (20)..(20): a, c, t, g, unknown or other
rccggaannnnnnatcgatn

SEQ ID NO: 1058 - DNA, 24 bp, Artificial Sequence
  source: /note="Description of Artificial Sequence: Synthetic oligonucleotide"
  modified_base (7)..(17): a, c, t, g, unknown or other
  modified_base (24)..(24): a, c, t, g, unknown or other
rccggannnnnnnnnnnacacctn

SEQ ID NO: 1059 - DNA, 24 bp, Artificial Sequence
  source: /note="Description of Artificial Sequence: Synthetic oligonucleotide"
  modified_base (7)..(17): a, c, t, g, unknown or other
  modified_base (24)..(24): a, c, t, g, unknown or other
rccggannnnnnnnnnnacacctn

SEQ ID NO: 1060 - DNA, 23 bp, Artificial Sequence
  source: /note="Description of Artificial Sequence: Synthetic oligonucleotide"
  modified_base (7)..(16): a, c, t, g, unknown or other
  modified_base (23)..(23): a, c, t, g, unknown or other
rccggannnnnnnnnntaatccn

SEQ ID NO: 1061 - DNA, 22 bp, Artificial Sequence
  source: /note="Description of Artificial Sequence: Synthetic oligonucleotide"
  modified_base (7)..(15): a, c, t, g, unknown or other
  modified_base (22)..(22): a, c, t, g, unknown or other
rccggannnnnnnnntaatccn

SEQ ID NO: 1062 - DNA, 21 bp, Artificial Sequence
  source: /note="Description of Artificial Sequence: Synthetic oligonucleotide"
  modified_base (7)..(14): a, c, t, g, unknown or other
  modified_base (21)..(21): a, c, t, g, unknown or other
rccggannnnnnnntaatccn

SEQ ID NO: 1063 - DNA, 12 bp, Artificial Sequence
  source: /note="Description of Artificial Sequence: Synthetic oligonucleotide"
  modified_base (12)..(12): a, c, t, g, unknown or other
rccggawgtkkn

SEQ ID NO: 1064 - DNA, 12 bp, Artificial Sequence
  source: /note="Description of Artificial Sequence: Synthetic oligonucleotide"
  modified_base (12)..(12): a, c, t, g, unknown or other
rccggawgtkkn

SEQ ID NO: 1065 - DNA, 12 bp, Artificial Sequence
  source: /note="Description of Artificial Sequence: Synthetic oligonucleotide"
rccggawgtkkw

SEQ ID NO: 1066 - DNA, 20 bp, Artificial Sequence
  source: /note="Description of Artificial Sequence: Synthetic oligonucleotide"
  modified_base (14)..(16): a, c, t, g, unknown or other
  modified_base (20)..(20): a, c, t, g, unknown or other
rgaatgcggaarynnntccn

SEQ ID NO: 1067 - DNA, 14 bp, Artificial Sequence
  source: /note="Description of Artificial Sequence: Synthetic oligonucleotide"
  modified_base (14)..(14): a, c, t, g, unknown or other
rgaatscggaagyn

SEQ ID NO: 1068 - DNA, 21 bp, Artificial Sequence
  source: /note="Description of Artificial Sequence: Synthetic oligonucleotide"
  modified_base (7)..(14): a, c, t, g, unknown or other
  modified_base (21)..(21): a, c, t, g, unknown or other
rggtgtnnnnnnnngaatgyn

SEQ ID NO: 1069 - DNA, 12 bp, Artificial Sequence
  source: /note="Description of Artificial Sequence: Synthetic oligonucleotide"
rggtgytaatwr

SEQ ID NO: 1070 - DNA, 16 bp, Artificial Sequence
  source: /note="Description of Artificial Sequence: Synthetic oligonucleotide"
  modified_base (6)..(8): a, c, t, g, unknown or other
  modified_base (15)..(16): a, c, t, g, unknown or other
rgtgtnnnaatatknn

SEQ ID NO: 1071 - DNA, 14 bp, Artificial Sequence
  source: /note="Description of Artificial Sequence: Synthetic oligonucleotide"
rgwatgttaatccs

SEQ ID NO: 1072 - DNA, 20 bp, Artificial Sequence
  source: /note="Description of Artificial Sequence: Synthetic oligonucleotide"
  modified_base (9)..(11): a, c, t, g, unknown or other
  modified_base (20)..(20): a, c, t, g, unknown or other
rkcacgtgnnnmcatatgkn

SEQ ID NO: 1073 - DNA, 21 bp, Artificial Sequence
  source: /note="Description of Artificial Sequence: Synthetic oligonucleotide"
  modified_base (4)..(4): a, c, t, g, unknown or other
  modified_base (20)..(21): a, c, t, g, unknown or other
rkrnrggcggaarcggaagnn

SEQ ID NO: 1074 - DNA, 13 bp, Artificial Sequence
  source: /note="Description of Artificial Sequence: Synthetic oligonucleotide"
  modified_base (13)..(13): a, c, t, g, unknown or other
rmatwccggawrn

SEQ ID NO: 1075 - DNA, 22 bp, Artificial Sequence
  source: /note="Description of Artificial Sequence: Synthetic oligonucleotide"
  modified_base (2)..(2): a, c, t, g, unknown or other
  modified_base (8)..(16): a, c, t, g, unknown or other
  modified_base (22)..(22): a, c, t, g, unknown or other
rncggaannnnnnnnngcaacn

SEQ ID NO: 1076 - DNA, 17 bp, Artificial Sequence
  source: /note="Description of Artificial Sequence: Synthetic oligonucleotide"
  modified_base (2)..(2): a, c, t, g, unknown or other
  modified_base (7)..(8): a, c, t, g, unknown or other
  modified_base (17)..(17): a, c, t, g, unknown or other
rncggannttgcgcaan

SEQ ID NO: 1077 - DNA, 17 bp, Artificial Sequence
  source: /note="Description of Artificial Sequence: Synthetic oligonucleotide"
  modified_base (2)..(2): a, c, t, g, unknown or other
  modified_base (7)..(8): a, c, t, g, unknown or other
  modified_base (17)..(17): a, c, t, g, unknown or other
rncggannttgcgcaan

SEQ ID NO: 1078 - DNA, 21 bp, Artificial Sequence
  source: /note="Description of Artificial Sequence: Synthetic oligonucleotide"
  modified_base (7)..(14): a, c, t, g, unknown or other
  modified_base (21)..(21): a, c, t, g, unknown or other
rrgtgtnnnnnnnnacaatrn

SEQ ID NO: 1079 - DNA, 12 bp, Artificial Sequence
  source: /note="Description of Artificial Sequence: Synthetic oligonucleotide"
rscggaaatrcm

SEQ ID NO: 1080 - DNA, 16 bp, Artificial Sequence
  source: /note="Description of Artificial Sequence: Synthetic oligonucleotide"
  modified_base (9)..(10): a, c, t, g, unknown or other
  modified_base (16)..(16): a, c, t, g, unknown or other
rscggaagnngtaaan

SEQ ID NO: 1081 - DNA, 16 bp, Artificial Sequence
  source: /note="Description of Artificial Sequence: Synthetic oligonucleotide"
  modified_base (10)..(10): a, c, t, g, unknown or other
  modified_base (16)..(16): a, c, t, g, unknown or other
rscggaagtngtaaan

SEQ ID NO: 1082 - DNA, 15 bp, Artificial Sequence
  source: /note="Description of Artificial Sequence: Synthetic oligonucleotide"
  modified_base (8)..(8): a, c, t, g, unknown or other
  modified_base (15)..(15): a, c, t, g, unknown or other
rscggaancacgtgn

SEQ ID NO: 1083 - DNA, 15 bp, Artificial Sequence
  source: /note="Description of Artificial Sequence: Synthetic oligonucleotide"
  modified_base (8)..(8): a, c, t, g, unknown or other
  modified_base (15)..(15): a, c, t, g, unknown or other
rscggaancacgtgn

SEQ ID NO: 1084 - DNA, 21 bp, Artificial Sequence
  source: /note="Description of Artificial Sequence: Synthetic oligonucleotide"
  modified_base (8)..(13): a, c, t, g, unknown or other
  modified_base (20)..(21): a, c, t, g, unknown or other
rscggaannnnnncacgtgnn

SEQ ID NO: 1085 - DNA, 22 bp, Artificial Sequence
  source: /note="Description of Artificial Sequence: Synthetic oligonucleotide"
  modified_base (8)..(14): a, c, t, g, unknown or other
  modified_base (21)..(22): a, c, t, g, unknown or other
rscggaannnnnnncacgtgnn

SEQ ID NO: 1086 - DNA, 20 bp, Artificial Sequence
  source: /note="Description of Artificial Sequence: Synthetic oligonucleotide"
  modified_base (8)..(14): a, c, t, g, unknown or other
rscggaannnnnnntaatkr

SEQ ID NO: 1087 - DNA, 20 bp, Artificial Sequence
  source: /note="Description of Artificial Sequence: Synthetic oligonucleotide"
  modified_base (8)..(13): a, c, t, g, unknown or other
  modified_base (20)..(20): a, c, t, g, unknown or other
rscggaannnnnnrtcgatn

SEQ ID NO: 1088 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
rscggaannnnnyaattan

SEQ ID NO: 1089 - DNA, 17 bp, Artificial Sequence
  source: /note="Description of Artificial Sequence: Synthetic oligonucleotide"
  modified_base (8)..(9): a, c, t, g, unknown or other
  modified_base (17)..(17): a, c, t, g, unknown or other
rscggaannrymaacan

SEQ ID NO: 1090 - DNA, 16 bp, Artificial Sequence
  source: /note="Description of Artificial Sequence: Synthetic oligonucleotide"
  modified_base (8)..(8): a, c, t, g, unknown or other
  modified_base (16)..(16): a, c, t, g, unknown or other
rscggaanrwmaacan

SEQ ID NO: 1091 - DNA, 15 bp, Artificial Sequence
  source: /note="Description of Artificial Sequence: Synthetic oligonucleotide"
  modified_base (15)..(15): a, c, t, g, unknown or other
rscggaarcaggtgn

SEQ ID NO: 1092 - DNA, 16 bp, Artificial Sequence
  source: /note="Description of Artificial Sequence: Synthetic oligonucleotide"
  modified_base (10)..(11): a, c, t, g, unknown or other
  modified_base (16)..(16): a, c, t, g, unknown or other
rscggaarynntaaan

SEQ ID NO: 1093 - DNA, 15 bp, Artificial Sequence
  source: /note="Description of Artificial Sequence: Synthetic oligonucleotide"
  modified_base (7)..(8): a, c, t, g, unknown or other
rscgganncatatgk

SEQ ID NO: 1094 - DNA, 13 bp, Artificial Sequence
  source: /note="Description of Artificial Sequence: Synthetic oligonucleotide"
  modified_base (13)..(13): a, c, t, g, unknown or other
rscggatgttrtn

SEQ ID NO: 1095 - DNA, 20 bp, Artificial Sequence
  source: /note="Description of Artificial Sequence: Synthetic oligonucleotide"
  modified_base (8)..(13): a, c, t, g, unknown or other
  modified_base (20)..(20): a, c, t, g, unknown or other
rscggawnnnnnnacaatrn

SEQ ID NO: 1096 - DNA, 21 bp, Artificial Sequence
  source: /note="Description of Artificial Sequence: Synthetic oligonucleotide"
  modified_base (8)..(14): a, c, t, g, unknown or other
  modified_base (21)..(21): a, c, t, g, unknown or other
rscggawnnnnnnnacaatrn

SEQ ID NO: 1097 - DNA, 11 bp, Artificial Sequence
  source: /note="Description of Artificial Sequence: Synthetic oligonucleotide"
rscggwaatkr

SEQ ID NO: 1098 - DNA, 11 bp, Artificial Sequence
  source: /note="Description of Artificial Sequence: Synthetic oligonucleotide"
rscggwaatkr

SEQ ID NO: 1099 - DNA, 13 bp, Artificial Sequence
  source: /note="Description of Artificial Sequence: Synthetic oligonucleotide"
  modified_base (6)..(8): a, c, t, g, unknown or other
rsgtgnnnaacgk

SEQ ID NO: 1100 - DNA, 15 bp, Artificial Sequence
  source: /note="Description of Artificial Sequence: Synthetic oligonucleotide"
  modified_base (9)..(9): a, c, t, g, unknown or other
  modified_base (15)..(15): a, c, t, g, unknown or other
rtaaacaynrtaaan

SEQ ID NO: 1101 - DNA, 14 bp, Artificial Sequence
  source: /note="Description of Artificial Sequence: Synthetic oligonucleotide"
  modified_base (14)..(14): a, c, t, g, unknown or other
rtaaacmggaaryn

SEQ ID NO: 1102 - DNA, 14 bp, Artificial Sequence
  source: /note="Description of Artificial Sequence: Synthetic oligonucleotide"
  modified_base (14)..(14): a, c, t, g, unknown or other
rtaaacmggaaryn

SEQ ID NO: 1103 - DNA, 13 bp, Artificial Sequence
  source: /note="Description of Artificial Sequence: Synthetic oligonucleotide"
  modified_base (8)..(8): a, c, t, g, unknown or other
  modified_base (12)..(13): a, c, t, g, unknown or other
rtaaatangggnn

SEQ ID NO: 1104 - DNA, 13 bp, Artificial Sequence
  source: /note="Description of Artificial Sequence: Synthetic oligonucleotide"
  modified_base (8)..(8): a, c, t, g, unknown or other
  modified_base (12)..(13): a, c, t, g, unknown or other
rtaaatangggnn

SEQ ID NO: 1105 - DNA, 16 bp, Artificial Sequence
  source: /note="Description of Artificial Sequence: Synthetic oligonucleotide"
  modified_base (9)..(9): a, c, t, g, unknown or other
  modified_base (16)..(16): a, c, t, g, unknown or other
rtcacgysnccggawn

SEQ ID NO: 1106 - DNA, 16 bp, Artificial Sequence
  source: /note="Description of Artificial Sequence: Synthetic oligonucleotide"
  modified_base (8)..(8): a, c, t, g, unknown or other
  modified_base (14)..(16): a, c, t, g, unknown or other
rtgcgggnaggtgnnn

SEQ ID NO: 1107 - DNA, 16 bp, Artificial Sequence
  source: /note="Description of Artificial Sequence: Synthetic oligonucleotide"
  modified_base (8)..(9): a, c, t, g, unknown or other
rtgcgggnnatcgatr

SEQ ID NO: 1108 - DNA, 21 bp, Artificial Sequence
  source: /note="Description of Artificial Sequence: Synthetic oligonucleotide"
  modified_base (8)..(14): a, c, t, g, unknown or other
  modified_base (21)..(21): a, c, t, g, unknown or other
rtgcgggnnnnnnncacgtgn

SEQ ID NO: 1109 - DNA, 16 bp, Artificial Sequence
  source: /note="Description of Artificial Sequence: Synthetic oligonucleotide"
  modified_base (8)..(10): a, c, t, g, unknown or other
rtgcgggnnntcgatr

SEQ ID NO: 1110 - DNA, 14 bp, Artificial Sequence
  source: /note="Description of Artificial Sequence: Synthetic oligonucleotide"
  modified_base (14)..(14): a, c, t, g, unknown or other
rtmaacaggaagtn

SEQ ID NO: 1111 - DNA, 14 bp, Artificial Sequence
  source: /note="Description of Artificial Sequence: Synthetic oligonucleotide"
  modified_base (14)..(14): a, c, t, g, unknown or other
rtmaacaggaagtn

SEQ ID NO: 1112 - DNA, 14 bp, Artificial Sequence
  source: /note="Description of Artificial Sequence: Synthetic oligonucleotide"
  modified_base (13)..(14): a, c, t, g, unknown or other
rtmaacaggaarnn

SEQ ID NO: 1113 - DNA, 13 bp, Artificial Sequence
  source: /note="Description of Artificial Sequence: Synthetic oligonucleotide"
  modified_base (13)..(13): a, c, t, g, unknown or other
rtmaacaggawrn

SEQ ID NO: 1114 - DNA, 15 bp, Artificial Sequence
  source: /note="Description of Artificial Sequence: Synthetic oligonucleotide"
  modified_base (15)..(15): a, c, t, g, unknown or other
rtrcgggtaataaan

SEQ ID NO: 1115 - DNA, 15 bp, Artificial Sequence
  source: /note="Description of Artificial Sequence: Synthetic oligonucleotide"
  modified_base (4)..(5): a, c, t, g, unknown or other
  modified_base (15)..(15): a, c, t, g, unknown or other
rtrnnggcggaagtn

SEQ ID NO: 1116 - DNA, 15 bp, Artificial Sequence
  source: /note="Description of Artificial Sequence: Synthetic oligonucleotide"
  modified_base (15)..(15): a, c, t, g, unknown or other
rtrygggcggaarkn

SEQ ID NO: 1117 - DNA, 17 bp, Artificial Sequence
  source: /note="Description of Artificial Sequence: Synthetic oligonucleotide"
  modified_base (9)..(10): a, c, t, g, unknown or other
  modified_base (16)..(17): a, c, t, g, unknown or other
rwcacgtgnncggaann

SEQ ID NO: 1118 - DNA, 21 bp, Artificial Sequence
  source: /note="Description of Artificial Sequence: Synthetic oligonucleotide"
  modified_base (10)..(15): a, c, t, g, unknown or other
  modified_base (20)..(21): a, c, t, g, unknown or other
rwmaacaggnnnnnnttccnn

SEQ ID NO: 1119 - DNA, 26 bp, Artificial Sequence
  source: /note="Description of Artificial Sequence: Synthetic oligonucleotide"
  modified_base (7)..(18): a, c, t, g, unknown or other
  modified_base (25)..(26): a, c, t, g, unknown or other
sgcgccnnnnnnnnnnnncagctgnn

SEQ ID NO: 1120 - DNA, 17 bp, Artificial Sequence
  source: /note="Description of Artificial Sequence: Synthetic oligonucleotide"
  modified_base (6)..(10): a, c, t, g, unknown or other
  modified_base (17)..(17): a, c, t, g, unknown or other
sgcgcnnnnncggaagn

SEQ ID NO: 1121 - DNA, 22 bp, Artificial Sequence
  source: /note="Description of Artificial Sequence: Synthetic oligonucleotide"
  modified_base (6)..(15): a, c, t, g, unknown or other
  modified_base (22)..(22): a, c, t, g, unknown or other
sgcgcnnnnnnnnnncggaagn

SEQ ID NO: 1122 - DNA, 23 bp, Artificial Sequence
  source: /note="Description of Artificial Sequence: Synthetic oligonucleotide"
  modified_base (6)..(16): a, c, t, g, unknown or other
  modified_base (23)..(23): a, c, t, g, unknown or other
sgcgcnnnnnnnnnnncggaagn

SEQ ID NO: 1123 - DNA, 16 bp, Artificial Sequence
  source: /note="Description of Artificial Sequence: Synthetic oligonucleotide"
  modified_base (9)..(9): a, c, t, g, unknown or other
  modified_base (15)..(16): a, c, t, g, unknown or other
sgtcacgcntcattnn

SEQ ID NO: 1124 - DNA, 20 bp, Artificial Sequence
  source: /note="Description of Artificial Sequence: Synthetic oligonucleotide"
  modified_base (8)..(13): a, c, t, g, unknown or other
  modified_base (20)..(20): a, c, t, g, unknown or other
symattannnnnnrgcaacn

SEQ ID NO: 1125 - DNA, 13 bp, Artificial Sequence
  source: /note="Description of Artificial Sequence: Synthetic oligonucleotide"
wtgmataacaatr

SEQ ID NO: 1126 - DNA, 16 bp, Artificial Sequence
  source: /note="Description of Artificial Sequence: Synthetic oligonucleotide"
  modified_base (2)..(2): a, c, t, g, unknown or other
  modified_base (7)..(7): a, c, t, g, unknown or other
  modified_base (16)..(16): a, c, t, g, unknown or other
ynattanrggtgtgan

SEQ ID NO: 1127 - DNA, 19 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
ncacgtgnnnnnncatwcc

SEQ ID NO: 1128 - DNA, 20 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
ncacgtgnnnnnnncatwcc

SEQ ID NO: 1129 - DNA, 21 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
ncagctgnnnnnnnntrcggg

SEQ ID NO: 1130 - DNA, 20 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
ncagctgnnnnnnntrcggg

SEQ ID NO: 1131 - DNA, 20 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
nccggaannnnnnnmatwcc

SEQ ID NO: 1132 - DNA, 16 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
ncrcgtgnnnggatta

SEQ ID NO: 1133 - DNA, 22 bp, Artificial Sequence
  source: /note="Description of Artificial Sequence: Synthetic oligonucleotide"
  modified_base (1)..(1): a, c, t, g, unknown or other
  modified_base (5)..(8): a, c, t, g, unknown or other
  modified_base (15)..(17): a, c, t, g, unknown or other
ngtgnnnnmatatknnnacacc

SEQ ID NO: 1134 - DNA, 18 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
nncrcgtgnnnnggatta

SEQ ID NO: 1135 - DNA, 21 bp, Artificial Sequence
  source: /note="Description of Artificial Sequence: Synthetic oligonucleotide"
  modified_base (1)..(2): a, c, t, g, unknown or other
  modified_base (19)..(19): a, c, t, g, unknown or other
nnmattagtcacgcwtsrntg

SEQ ID NO: 1136 - DNA, 21 bp, Artificial Sequence
  source: /note="Description of Artificial Sequence: Synthetic oligonucleotide"
  modified_base (1)..(2): a, c, t, g, unknown or other
  modified_base (19)..(19): a, c, t, g, unknown or other
nnmattagtcacgcwtsrntg

SEQ ID NO: 1137 - DNA, 21 bp, Artificial Sequence
  source: /note="Description of Artificial Sequence: Synthetic oligonucleotide"
  modified_base (1)..(2): a, c, t, g, unknown or other
  modified_base (19)..(19): a, c, t, g, unknown or other
nnmattagtcacgcwtsrntg

SEQ ID NO: 1138 - DNA, 15 bp, Artificial Sequence
  source: /note="Description of Artificial Sequence: Synthetic oligonucleotide"
  modified_base (1)..(3): a, c, t, g, unknown or other
nnntatgcagygtka

SEQ ID NO: 1139 - DNA, 19 bp, Artificial Sequence
  source: /note="Description of Artificial Sequence: Synthetic oligonucleotide"
  modified_base (1)..(2): a, c, t, g, unknown or other
  modified_base (9)..(11): a, c, t, g, unknown or other
  modified_base (14)..(16): a, c, t, g, unknown or other
nntcccgcnnnccnnnggc

SEQ ID NO: 1140 - DNA, 22 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (13)..(16): a, c, t, g, unknown or other
nsccnnnrggcannnnymatta

SEQ ID NO: 1141 - DNA, 19 bp, Artificial Sequence
  source: /note="Description of Artificial Sequence: Synthetic oligonucleotide"
  modified_base (1)..(1): a, c, t, g, unknown or other
  modified_base (18)..(18): a, c, t, g, unknown or other
nscggacggawatccgsnt

SEQ ID NO: 1142 - DNA, 17 bp, Artificial Sequence
  source: /note="Description of Artificial Sequence: Synthetic oligonucleotide"
  modified_base (1)..(1): a, c, t, g, unknown or other
  modified_base (7)..(11): a, c, t, g, unknown or other
nscggannnnnggmtta

SEQ ID NO: 1143 - DNA, 18 bp, Artificial Sequence
  source: /note="Description of Artificial Sequence: Synthetic oligonucleotide"
  modified_base (1)..(1): a, c, t, g, unknown or other
  modified_base (7)..(12): a, c, t, g, unknown or other
nscggannnnnnggmtta

SEQ ID NO: 1144 - DNA, 16 bp, Artificial Sequence
  source: /note="Description of Artificial Sequence: Synthetic oligonucleotide"
  modified_base (1)..(1): a, c, t, g, unknown or other
  modified_base (4)..(4): a, c, t, g, unknown or other
  modified_base (8)..(10): a, c, t, g, unknown or other
ntrngggnnncacgtg

SEQ ID NO: 1145 - DNA, 15 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (9)..(9): a, c, t, g, unknown or other
ntttatnrntmaaca

SEQ ID NO: 1146 - DNA, 22 bp, Artificial Sequence
  source: /note="Description of Artificial Sequence: Synthetic oligonucleotide"
  modified_base (8)..(15): a, c, t, g, unknown or other
  modified_base (17)..(18): a, c, t, g, unknown or other
rcatwccnnnnnnnnynntaaa

SEQ ID NO: 1147 - DNA, 16 bp, Artificial Sequence
  source: /note="Description of Artificial Sequence: Synthetic oligonucleotide"
  modified_base (7)..(10): a, c, t, g, unknown or other
rcatwcnnnnggatta

SEQ ID NO: 1148 - DNA, 17 bp, Artificial Sequence
  source: /note="Description of Artificial Sequence: Synthetic oligonucleotide"
  modified_base (7)..(11): a, c, t, g, unknown or other
rcatwcnnnnnggatta

SEQ ID NO: 1149 - DNA, 18 bp, Artificial Sequence
  source: /note="Description of Artificial Sequence: Synthetic oligonucleotide"
  modified_base (7)..(12): a, c, t, g, unknown or other
rcatwcnnnnnnaggtca

SEQ ID NO: 1150 - DNA, 18 bp, Artificial Sequence
  source: /note="Description of Artificial Sequence: Synthetic oligonucleotide"
  modified_base (8)..(12): a, c, t, g, unknown or other
rcatwcynnnnntaatcc

SEQ ID NO: 1151 - DNA, 17 bp, Artificial Sequence
  source: /note="Description of Artificial Sequence: Synthetic oligonucleotide"
  modified_base (8)..(11): a, c, t, g, unknown or other
rcatwcynnnntaatcc

SEQ ID NO: 1152 - DNA, 18 bp, Artificial Sequence
  source: /note="Description of Artificial Sequence: Synthetic oligonucleotide"
  modified_base (9)..(12): a, c, t, g, unknown or other
rggtgtkannnnggatta

SEQ ID NO: 1153 - DNA, 31 bp, Artificial Sequence
  source: /note="Description of Artificial Sequence: Synthetic oligonucleotide"
  modified_base (9)..(24): a, c, t, g, unknown or other
rmatatkcnnnnnnnnnnnnnnnnrwmaaca

SEQ ID NO: 1154 - DNA, 30 bp, Artificial Sequence
  source: /note="Description of Artificial Sequence: Synthetic oligonucleotide"
  modified_base (9)..(23): a, c, t, g, unknown or other
rmatatkcnnnnnnnnnnnnnnnrwmaaca

SEQ ID NO: 1155 - DNA, 28 bp, Artificial Sequence
  source: /note="Description of Artificial Sequence: Synthetic oligonucleotide"
  modified_base (9)..(21): a, c, t, g, unknown or other
rmatatkcnnnnnnnnnnnnnrwmaaca

SEQ ID NO: 1156 - DNA, 14 bp, Artificial Sequence
  source: /note="Description of Artificial Sequence: Synthetic oligonucleotide"
  modified_base (2)..(2): a, c, t, g, unknown or other
rncggawgtmatta

SEQ ID NO: 1157 - DNA, 21 bp, Artificial Sequence
  source: /note="Description of Artificial Sequence: Synthetic oligonucleotide"
  modified_base (8)..(15): a, c, t, g, unknown or other
rscggaannnnnnnncatwcc

SEQ ID NO: 1158 - DNA, 16 bp, Artificial Sequence
  source: /note="Description of Artificial Sequence: Synthetic oligonucleotide"
  modified_base (8)..(8): a, c, t, g, unknown or other
rscggaantsrcgtga

SEQ ID NO: 1159 - DNA, 17 bp, Artificial Sequence
  source: /note="Description of Artificial Sequence: Synthetic oligonucleotide"
  modified_base (9)..(9): a, c, t, g, unknown or other
rscggaasngrtcgata

SEQ ID NO: 1160 - DNA, 23 bp, Artificial Sequence
  source: /note="Description of Artificial Sequence: Synthetic oligonucleotide"
  modified_base (11)..(18): a, c, t, g, unknown or other
rscggwaatknnnnnnnnmatta

SEQ ID NO: 1161 - DNA, 17 bp, Artificial Sequence
  source: /note="Description of Artificial Sequence: Synthetic oligonucleotide"
  modified_base (8)..(11): a, c, t, g, unknown or other
rscggwannnnymatta

SEQ ID NO: 1162 - DNA, 14 bp, Artificial Sequence
  source: /note="Description of Artificial Sequence: Synthetic oligonucleotide"
rsmggawgyaatta

SEQ ID NO: 1163 - DNA, 14 bp, Artificial Sequence
  source: /note="Description of Artificial Sequence: Synthetic oligonucleotide"
  modified_base (8)..(8): a, c, t, g, unknown or other
rtaaacwnatwaaa

SEQ ID NO: 1164 - DNA, 13 bp, Artificial Sequence
  source: /note="Description of Artificial Sequence: Synthetic oligonucleotide"
  modified_base (4)..(4): a, c, t, g, unknown or other
rtgnkggcggawg

SEQ ID NO: 1165 - DNA, 14 bp, Artificial Sequence
  source: /note="Description of Artificial Sequence: Synthetic oligonucleotide"
  modified_base (8)..(9): a, c, t, g, unknown or other
rtrcgggnngatta

SEQ ID NO: 1166 - DNA, 19 bp, Artificial Sequence
  source: /note="Description of Artificial Sequence: Synthetic oligonucleotide"
  modified_base (8)..(11): a, c, t, g, unknown or other
rtrcgggnnnnttacgtaa

SEQ ID NO: 1167 - DNA, 16 bp, Artificial Sequence
  source: /note="Description of Artificial Sequence: Synthetic oligonucleotide"
rwmaacasymrtwaaa

SEQ ID NO: 1168 - DNA, 17 bp, Artificial Sequence
  source: /note="Description of Artificial Sequence: Synthetic oligonucleotide"
  modified_base (4)..(6): a, c, t, g, unknown or other
  modified_base (10)..(11): a, c, t, g, unknown or other
sccnnnggcnnyaatta

SEQ ID NO: 1169 - DNA, 16 bp, Artificial Sequence
  source: /note="Description of Artificial Sequence: Synthetic oligonucleotide"
  modified_base (8)..(8): a, c, t, g, unknown or other
syaattanwggtgyga

SEQ ID NO: 1170 - DNA, 17 bp, Artificial Sequence
  source: /note="Description of Artificial Sequence: Synthetic oligonucleotide"
  modified_base (10)..(11): a, c, t, g, unknown or other
wtwtgcatanntaatta

SEQ ID NO: 1171 - DNA, 14 bp, Artificial Sequence
  source: /note="Description of Artificial Sequence: Synthetic oligonucleotide"
  modified_base (2)..(2): a, c, t, g, unknown or other
ynrcacstcgtwaa

SEQ ID NO: 1172 - DNA, 15 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
  modified_base (14)..(15): a, c, t, g, unknown or other
naacggnnatygann

SEQ ID NO: 1173 - DNA, 23 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (17)..(18): a, c, t, g, unknown or other
  modified_base (22)..(23): a, c, t, g, unknown or other
natcgatnnnnngcctnnggsnn

SEQ ID NO: 1174 - DNA, 25 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
  modified_base (19)..(20): a, c, t, g, unknown or other
  modified_base (24)..(25): a, c, t, g, unknown or other
natcgatnnnnnnngcctnnggsnn

SEQ ID NO: 1175 - DNA, 26 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
  modified_base (20)..(21): a, c, t, g, unknown or other
  modified_base (25)..(26): a, c, t, g, unknown or other
natcgatnnnnnnnngcctnnggsnn

SEQ ID NO: 1176 - DNA, 22 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
natcratnnnnnnnaacaatrs

SEQ ID NO: 1177 - DNA, 23 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
natcratnnnnnnnnaacaatrs

SEQ ID NO: 1178 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(17): a, c, t, g, unknown or other
natttrcnnnacaatrn

SEQ ID NO: 1179 - DNA, 17 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
  modified_base (16)..(17): a, c, t, g, unknown or other
ncacgtgnnyaacsgnn

SEQ ID NO: 1180 - DNA, 15 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (15)..(15): a, c, t, g, unknown or other
ncaggtgngwatgyn

SEQ ID NO: 1181 - DNA, 20 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
ncagstgnnnnnngtaatkr

SEQ ID NO: 1182 - DNA, 21 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
ncagstgnnnnnnngtaatkr

SEQ ID NO: 1183 - DNA, 23 bp, Artificial Sequence
  source: /note="Description of Artificial Sequence: Synthetic oligonucleotide"
  modified_base (1)..(1): a, c, t, g, unknown or other
  modified_base (9)..(16): a, c, t, g, unknown or other
  modified_base (23)..(23): a, c, t, g, unknown or other
ncasstgknnnnnnnncacgtgn

SEQ ID NO: 1184 - DNA, 24 bp, Artificial Sequence
  source: /note="Description of Artificial Sequence: Synthetic oligonucleotide"
  modified_base (1)..(1): a, c, t, g, unknown or other
  modified_base (9)..(17): a, c, t, g, unknown or other
  modified_base (24)..(24): a, c, t, g, unknown or other
ncasstgknnnnnnnnncacgtgn

SEQ ID NO: 1185 - DNA, 21 bp, Artificial Sequence
  source: /note="Description of Artificial Sequence: Synthetic oligonucleotide"
  modified_base (1)..(1): a, c, t, g, unknown or other
  modified_base (10)..(11): a, c, t, g, unknown or other
  modified_base (13)..(13): a, c, t, g, unknown or other
nccggaagynncntagcaacs

SEQ ID NO: 1186 - DNA, 21 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
  modified_base (20)..(21): a, c, t, g, unknown or other
nccggaannnnnncacgygnn

SEQ ID NO: 1187 - DNA, 16 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (10)..(10): a, c, t, g, unknown or other
  modified_base (16)..(16): a, c, t, g, unknown or other
nccggaantnrtaaan

SEQ ID NO: 1188 - DNA, 15 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
nccgganncasstgy

SEQ ID NO: 1189 - DNA, 17 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
ngataasnnnrgwatgy

SEQ ID NO: 1190 - DNA, 20 bp, Artificial Sequence
  source: /note="Description of Artificial Sequence: Synthetic oligonucleotide"
  modified_base (1)..(1): a, c, t, g, unknown or other
  modified_base (6)..(7): a, c, t, g, unknown or other
  modified_base (11)..(12): a, c, t, g, unknown or other
  modified_base (20)..(20): a, c, t, g, unknown or other
ngcctnnggsnncggaagyn

SEQ ID NO: 1191 - DNA, 23 bp, Artificial Sequence
  source: /note="Description of Artificial Sequence: Synthetic oligonucleotide"
  modified_base (1)..(1): a, c, t, g, unknown or other
  modified_base (8)..(9): a, c, t, g, unknown or other
  modified_base (16)..(19): a, c, t, g, unknown or other
  modified_base (23)..(23): a, c, t, g, unknown or other
nggtgtgnnggcgcsnnnncrmn

SEQ ID NO: 1192 - DNA, 19 bp, Artificial Sequence
  source: /note="Description of Artificial Sequence: Synthetic oligonucleotide"
  modified_base (1)..(2): a, c, t, g, unknown or other
  modified_base (9)..(12): a, c, t, g, unknown or other
  modified_base (19)..(19): a, c, t, g, unknown or other
nncacgtgnnnnrgmttan

SEQ ID NO: 1193 - DNA, 24 bp, Artificial Sequence
  source: /note="Description of Artificial Sequence: Synthetic oligonucleotide"
  modified_base (1)..(2): a, c, t, g, unknown or other
  modified_base (9)..(17): a, c, t, g, unknown or other
  modified_base (24)..(24): a, c, t, g, unknown or other
nncagctgnnnnnnnnnatygatn

SEQ ID NO: 1194 - DNA, 15 bp, Artificial Sequence
  source: /note="Description of Artificial Sequence: Synthetic oligonucleotide"
  modified_base (1)..(2): a, c, t, g, unknown or other
  modified_base (15)..(15): a, c, t, g, unknown or other
nncggawgymattan

SEQ ID NO: 1195 - DNA, 17 bp, Artificial Sequence
  source: /note="Description of Artificial Sequence: Synthetic oligonucleotide"
  modified_base (1)..(2): a, c, t, g, unknown or other
  modified_base (17)..(17): a, c, t, g, unknown or other
nnggamggatktccgsn

SEQ ID NO: 1196 - DNA, 15 bp, Artificial Sequence
  source: /note="Description of Artificial Sequence: Synthetic oligonucleotide"
  modified_base (1)..(2): a, c, t, g, unknown or other
  modified_base (10)..(10): a, c, t, g, unknown or other
nngtmaatangggyr

SEQ ID NO: 1197 - DNA, 24 bp, Artificial Sequence
  source: /note="Description of Artificial Sequence: Synthetic oligonucleotide"
  modified_base (1)..(2): a, c, t, g, unknown or other
  modified_base (6)..(13): a, c, t, g, unknown or other
  modified_base (23)..(24): a, c, t, g, unknown or other
nngygnnnnnnnnwaacaacacnn

SEQ ID NO: 1198 - DNA, 15 bp, Artificial Sequence
  source: /note="Description of Artificial Sequence: Synthetic oligonucleotide"
  modified_base (1)..(2): a, c, t, g, unknown or other
  modified_base (15)..(15): a, c, t, g, unknown or other
nngygysacattccn

SEQ ID NO: 1199 - DNA, 15 bp, Artificial Sequence
  source: /note="Description of Artificial Sequence: Synthetic oligonucleotide"
  modified_base (1)..(2): a, c, t, g, unknown or other
  modified_base (15)..(15): a, c, t, g, unknown or other
nnmggaartgckggn

SEQ ID NO: 1200 - DNA, 17 bp, Artificial Sequence
  source: /note="Description of Artificial Sequence: Synthetic oligonucleotide"
  modified_base (1)..(2): a, c, t, g, unknown or other
  modified_base (9)..(9): a, c, t, g, unknown or other
  modified_base (16)..(17): a, c, t, g, unknown or other
nnmrtaaantmacacnn

SEQ ID NO: 1201 - DNA, 25 bp, Artificial Sequence
  source: /note="Description of Artificial Sequence: Synthetic oligonucleotide"
  modified_base (1)..(3): a, c, t, g, unknown or other
  modified_base (9)..(13): a, c, t, g, unknown or other
  modified_base (17)..(19): a, c, t, g, unknown or other
  modified_base (25)..(25): a, c, t, g, unknown or other
nnnmggaannnnntccnnnrcaacn

SEQ ID NO: 1202 - DNA, 18 bp, Artificial Sequence
  source: /note="Description of Artificial Sequence: Synthetic oligonucleotide"
  modified_base (1)..(3): a, c, t, g, unknown or other
  modified_base (9)..(10): a, c, t, g, unknown or other
  modified_base (12)..(12): a, c, t, g, unknown or other
  modified_base (18)..(18): a, c, t, g, unknown or other
nnnrtaaanntnacacyn

SEQ ID NO: 1203 - DNA, 16 bp, Artificial Sequence
  source: /note="Description of Artificial Sequence: Synthetic oligonucleotide"
  modified_base (1)..(3): a, c, t, g, unknown or other
nnnrtaaawatygayy

SEQ ID NO: 1204 - DNA, 18 bp, Artificial Sequence
  source: /note="Description of Artificial Sequence: Synthetic oligonucleotide"
  modified_base (1)..(2): a, c, t, g, unknown or other
  modified_base (9)..(9): a, c, t, g, unknown or other
nnrgyaacntcacgtgay

SEQ ID NO: 1205 - DNA, 29 bp, Artificial Sequence
  source: /note="Description of Artificial Sequence: Synthetic oligonucleotide"
  modified_base (1)..(1): a, c, t, g, unknown or other
  modified_base (7)..(7): a, c, t, g, unknown or other
  modified_base (9)..(21): a, c, t, g, unknown or other
  modified_base (28)..(29): a, c, t, g, unknown or other
nrgtgtnannnnnnnnnnnnnccggaann

SEQ ID NO: 1206 - DNA, 18 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (18)..(18): a, c, t, g, unknown or other
nrgyaacnnncatatgkn

SEQ ID NO: 1207 - DNA, 17 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (17)..(17): a, c, t, g, unknown or other
nrtcratancggaaryn

SEQ ID NO: 1208 - DNA, 15 bp, Artificial Sequence
  source: /note="Description of Artificial Sequence: Synthetic oligonucleotide"
  modified_base (1)..(1): a, c, t, g, unknown or other
  modified_base (15)..(15): a, c, t, g, unknown or other
nrtmaacmggaaryn

SEQ ID NO: 1209 - DNA, 24 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (13)..(18): a, c, t, g, unknown or other
nsccnnnrggcannnnnntaatkr

SEQ ID NO: 1210 - DNA, 23 bp, Artificial Sequence
  source: /note="Description of Artificial Sequence: Synthetic oligonucleotide"
  modified_base (1)..(1): a, c, t, g, unknown or other
  modified_base (5)..(7): a, c, t, g, unknown or other
  modified_base (13)..(17): a, c, t, g, unknown or other
nsccnnnrggcannnnntaatkr

SEQ ID NO: 1211 - DNA, 18 bp, Artificial Sequence
  source: /note="Description of Artificial Sequence: Synthetic oligonucleotide"
  modified_base (1)..(1): a, c, t, g, unknown or other
  modified_base (9)..(11): a, c, t, g, unknown or other
  modified_base (18)..(18): a, c, t, g, unknown or other
ntcacacmnnnatcratn

SEQ ID NO: 1212 - DNA, 18 bp, Artificial Sequence
  source: /note="Description of Artificial Sequence: Synthetic oligonucleotide"
  modified_base (1)..(1): a, c, t, g, unknown or other
  modified_base (8)..(8): a, c, t, g, unknown or other
  modified_base (18)..(18): a, c, t, g, unknown or other
ntgacagntaatcratan

SEQ ID NO: 1213 - DNA, 23 bp, Artificial Sequence
  source: /note="Description of Artificial Sequence: Synthetic oligonucleotide"
  modified_base (1)..(1): a, c, t, g, unknown or other
  modified_base (3)..(5): a, c, t, g, unknown or other
  modified_base (14)..(16): a, c, t, g, unknown or other
  modified_base (21)..(23): a, c, t, g, unknown or other
ntnnnggcggaagnnnttccnnn

SEQ ID NO: 1214 - DNA, 23 bp, Artificial Sequence
  source: /note="Description of Artificial Sequence: Synthetic oligonucleotide"
  modified_base (1)..(1): a, c, t, g, unknown or other
  modified_base (4)..(4): a, c, t, g, unknown or other
  modified_base (14)..(16): a, c, t, g, unknown or other
  modified_base (21)..(23): a, c, t, g, unknown or other
ntrngggcggaagnnnttccnnn

SEQ ID NO: 1215 - DNA, 20 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (20)..(20): a, c, t, g, unknown or other
ntrygggnnntggcgggarn

SEQ ID NO: 1216 - DNA, 16 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (16)..(16): a, c, t, g, unknown or other
nymrtaaanatygatn

SEQ ID NO: 1217 - DNA, 23 bp, Artificial Sequence
  source: /note="Description of Artificial Sequence: Synthetic oligonucleotide"
  modified_base (7)..(16): a, c, t, g, unknown or other
  modified_base (23)..(23): a, c, t, g, unknown or other
rattccnnnnnnnnnncasstgn

SEQ ID NO: 1218 - DNA, 29 bp, Artificial Sequence
  source: /note="Description of Artificial Sequence: Synthetic oligonucleotide"
  modified_base (8)..(19): a, c, t, g, unknown or other
  modified_base (29)..(29): a, c, t, g, unknown or other
rcatwccnnnnnnnnnnnnrwgcgtgacn

SEQ ID NO: 1219 - DNA, 21 bp, Artificial Sequence
  source: /note="Description of Artificial Sequence: Synthetic oligonucleotide"
  modified_base (8)..(13): a, c, t, g, unknown or other
  modified_base (19)..(21): a, c, t, g, unknown or other
rcatwccnnnnnntttaynnn

SEQ ID NO: 1220 - DNA, 21 bp, Artificial Sequence
  source: /note="Description of Artificial Sequence: Synthetic oligonucleotide"
  modified_base (8)..(13): a, c, t, g, unknown or other
  modified_base (21)..(21): a, c, t, g, unknown or other
rccggaannnnnnratcratn

SEQ ID NO: 1221 - DNA, 16 bp, Artificial Sequence
  source: /note="Description of Artificial Sequence: Synthetic oligonucleotide"
  modified_base (15)..(16): a, c, t, g, unknown or other
rccggaarcasstgnn

SEQ ID NO: 1222 - DNA, 18 bp, Artificial Sequence
  source: /note="Description of Artificial Sequence: Synthetic oligonucleotide"
  modified_base (7)..(7): a, c, t, g, unknown or other
  modified_base (9)..(10): a, c, t, g, unknown or other
  modified_base (18)..(18): a, c, t, g, unknown or other
rccgganrnncggwatkn

SEQ ID NO: 1223 - DNA, 13 bp, Artificial Sequence
  source: /note="Description of Artificial Sequence: Synthetic oligonucleotide"
  modified_base (6)..(6): a, c, t, g, unknown or other
  modified_base (13)..(13): a, c, t, g, unknown or other
rggtgntaakccn

SEQ ID NO: 1224 - DNA, 25 bp, Artificial Sequence
  source: /note="Description of Artificial Sequence: Synthetic oligonucleotide"
  modified_base (6)..(6): a, c, t, g, unknown or other
  modified_base (11)..(19): a, c, t, g, unknown or other
  modified_base (24)..(25): a, c, t, g, unknown or other
rggtgntaatnnnnnnnnncasynn

SEQ ID NO: 1225 - DNA, 13 bp, Artificial Sequence
  source: /note="Description of Artificial Sequence: Synthetic oligonucleotide"
  modified_base (13)..(13): a, c, t, g, unknown or other
rgwatgytaatkn

SEQ ID NO: 1226 - DNA, 13 bp, Artificial Sequence
  source: /note="Description of Artificial Sequence: Synthetic oligonucleotide"
rgwatgytaatkr

SEQ ID NO: 1227 - DNA, 20 bp, Artificial Sequence
  source: /note="Description of Artificial Sequence: Synthetic oligonucleotide"
  modified_base (2)..(2): a, c, t, g, unknown or other
  modified_base (9)..(13): a, c, t, g, unknown or other
  modified_base (20)..(20): a, c, t, g, unknown or other
rncggaagnnnnncasstgn

SEQ ID NO: 1228 - DNA, 16 bp, Artificial Sequence
  source: /note="Description of Artificial Sequence: Synthetic oligonucleotide"
  modified_base (2)..(2): a, c, t, g, unknown or other
  modified_base (8)..(8): a, c, t, g, unknown or other
  modified_base (10)..(10): a, c, t, g, unknown or other
  modified_base (16)..(16): a, c, t, g, unknown or other
rncggaanynrtwaan

SEQ ID NO: 1229 - DNA, 29 bp, Artificial Sequence
  source: /note="Description of Artificial Sequence: Synthetic oligonucleotide"
  modified_base (2)..(2): a, c, t, g, unknown or other
  modified_base (6)..(18): a, c, t, g, unknown or other
  modified_base (29)..(29): a, c, t, g, unknown or other
rngtgnnnnnnnnnnnnnrcrccggawsn

SEQ ID NO: 1230 - DNA, 29 bp, Artificial Sequence
  source: /note="Description of Artificial Sequence: Synthetic oligonucleotide"
  modified_base (8)..(21): a, c, t, g, unknown or other
  modified_base (27)..(29): a, c, t, g, unknown or other
rrgtgtknnnnnnnnnnnnnncmggannn

SEQ ID NO: 1231 - DNA, 18 bp, Artificial Sequence
  source: /note="Description of Artificial Sequence: Synthetic oligonucleotide"
  modified_base (8)..(10): a, c, t, g, unknown or other
  modified_base (18)..(18): a, c, t, g, unknown or other
rrtcratnnncggaaryn

SEQ ID NO: 1232 - DNA, 16 bp, Artificial Sequence
  source: /note="Description of Artificial Sequence: Synthetic oligonucleotide"
  modified_base (8)..(8): a, c, t, g, unknown or other
  modified_base (15)..(16): a, c, t, g, unknown or other
rscggaancagstgnn

SEQ ID NO: 1233 - DNA, 16 bp, Artificial Sequence
  source: /note="Description of Artificial Sequence: Synthetic oligonucleotide"
  modified_base (8)..(8): a, c, t, g, unknown or other
  modified_base (15)..(16): a, c, t, g, unknown or other
rscggaancasctgnn

SEQ ID NO: 1234 - DNA, 15 bp, Artificial Sequence
  source: /note="Description of Artificial Sequence: Synthetic oligonucleotide"
  modified_base (8)..(8): a, c, t, g, unknown or other
  modified_base (15)..(15): a, c, t, g, unknown or other
rscggaancasstgn

SEQ ID NO: 1235 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
rscggaannnnnggmttan

SEQ ID NO: 1236 - DNA, 18 bp, Artificial Sequence
  source: /note="Description of Artificial Sequence: Synthetic oligonucleotide"
  modified_base (9)..(9): a, c, t, g, unknown or other
  modified_base (18)..(18): a, c, t, g, unknown or other
rscggaasngrtcgatan

SEQ ID NO: 1237 - DNA, 17 bp, Artificial Sequence
  source: /note="Description of Artificial Sequence: Synthetic oligonucleotide"
  modified_base (7)..(8): a, c, t, g, unknown or other
  modified_base (17)..(17): a, c, t, g, unknown or other
rscggannttgcgyaan

SEQ ID NO: 1238 - DNA, 15 bp, Artificial Sequence
  source: /note="Description of Artificial Sequence: Synthetic oligonucleotide"
  modified_base (15)..(15): a, c, t, g, unknown or other
rscggawrcasstgn

SEQ ID NO: 1239 - DNA, 18 bp, Artificial Sequence
  source: /note="Description of Artificial Sequence: Synthetic oligonucleotide"
  modified_base (10)..(13): a, c, t, g, unknown or other
  modified_base (18)..(18): a, c, t, g, unknown or other
rscggwaatnnnnattan

SEQ ID NO: 1240 - DNA, 19 bp, Artificial Sequence
  source: /note="Description of Artificial Sequence: Synthetic oligonucleotide"
  modified_base (10)..(14): a, c, t, g, unknown or other
  modified_base (19)..(19): a, c, t, g, unknown or other
rscggwaatnnnnnattan

SEQ ID NO: 1241 - DNA, 18 bp, Artificial Sequence
  source: /note="Description of Artificial Sequence: Synthetic oligonucleotide"
  modified_base (10)..(12): a, c, t, g, unknown or other
  modified_base (18)..(18): a, c, t, g, unknown or other
rscggwaatnnnyattan

SEQ ID NO: 1242 - DNA, 17 bp, Artificial Sequence
  source: /note="Description of Artificial Sequence: Synthetic oligonucleotide"
  modified_base (8)..(8): a, c, t, g, unknown or other
  modified_base (17)..(17): a, c, t, g, unknown or other
rsmggaanttgcgyaan

SEQ ID NO: 1243 - DNA, 16 bp, Artificial Sequence
  source: /note="Description of Artificial Sequence: Synthetic oligonucleotide"
  modified_base (10)..(11): a, c, t, g, unknown or other
  modified_base (16)..(16): a, c, t, g, unknown or other
rsmggaartnntaaan

SEQ ID NO: 1244 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
rtaaacannnnnatcratn

SEQ ID NO: 1245 - DNA, 19 bp, Artificial Sequence
  source: /note="Description of Artificial Sequence: Synthetic oligonucleotide"
  modified_base (8)..(12): a, c, t, g, unknown or other
  modified_base (19)..(19): a, c, t, g, unknown or other
rtaaacannnnnatcratn

SEQ ID NO: 1246 - DNA, 14 bp, Artificial Sequence
  source: /note="Description of Artificial Sequence: Synthetic oligonucleotide"
  modified_base (10)..(10): a, c, t, g, unknown or other
  modified_base (14)..(14): a, c, t, g, unknown or other
rtmaacatrngggn

SEQ ID NO: 1247 - DNA, 14 bp, Artificial Sequence
  source: /note="Description of Artificial Sequence: Synthetic oligonucleotide"
  modified_base (14)..(14): a, c, t, g, unknown or other
rtmaatamgggyrn

SEQ ID NO: 1248 - DNA, 16 bp, Artificial Sequence
  source: /note="Description of Artificial Sequence: Synthetic oligonucleotide"
  modified_base (16)..(16): a, c, t, g, unknown or other
rtmrcgtgacggawgn

SEQ ID NO: 1249 - DNA, 22 bp, Artificial Sequence
  source: /note="Description of Artificial Sequence: Synthetic oligonucleotide"
  modified_base (8)..(14): a, c, t, g, unknown or other
  modified_base (21)..(22): a, c, t, g, unknown or other
rtrcgggnnnnnnnywttgtnn

SEQ ID NO: 1250 - DNA, 19 bp, Artificial Sequence
  source: /note="Description of Artificial Sequence: Synthetic oligonucleotide"
  modified_base (8)..(13): a, c, t, g, unknown or other
rtrcgggnnnnnntaatkr

SEQ ID NO: 1251 - DNA, 18 bp, Artificial Sequence
  source: /note="Description of Artificial Sequence: Synthetic oligonucleotide"
  modified_base (8)..(12): a, c, t, g, unknown or other
rtrcgggnnnnntaatkr

SEQ ID NO: 1252 - DNA, 18 bp, Artificial Sequence
  source: /note="Description of Artificial Sequence: Synthetic oligonucleotide"
  modified_base (8)..(12): a, c, t, g, unknown or other
rtrcgggnnnnntaattr

SEQ ID NO: 1253 - DNA, 19 bp, Artificial Sequence
  source: /note="Description of Artificial Sequence: Synthetic oligonucleotide"
  modified_base (8)..(11): a, c, t, g, unknown or other
  modified_base (13)..(13): a, c, t, g, unknown or other
  modified_base (19)..(19): a, c, t, g, unknown or other
rtrcgggnnnnrnacaawn

SEQ ID NO: 1254 - DNA, 18 bp, Artificial Sequence
  source: /note="Description of Artificial Sequence: Synthetic oligonucleotide"
  modified_base (8)..(10): a, c, t, g, unknown or other
  modified_base (12)..(12): a, c, t, g, unknown or other
  modified_base (18)..(18): a, c, t, g, unknown or other
rtrcgggnnnrnacaawn

SEQ ID NO: 1255 - DNA, 14 bp, Artificial Sequence
  source: /note="Description of Artificial Sequence: Synthetic oligonucleotide"
  modified_base (14)..(14): a, c, t, g, unknown or other
rtrcgggsgattan

SEQ ID NO: 1256 - DNA, 15 bp, Artificial Sequence
  source: /note="Description of Artificial Sequence: Synthetic oligonucleotide"
  modified_base (4)..(4): a, c, t, g, unknown or other
  modified_base (9)..(10): a, c, t, g, unknown or other
  modified_base (15)..(15): a, c, t, g, unknown or other
rtrngggtnntaaan

SEQ ID NO: 1257 - DNA, 14 bp, Artificial Sequence
  source: /note="Description of Artificial Sequence: Synthetic oligonucleotide"
  modified_base (8)..(8): a, c, t, g, unknown or other
  modified_base (14)..(14): a, c, t, g, unknown or other
rtrsgggnaattan

SEQ ID NO: 1258 - DNA, 15 bp, Artificial Sequence
  source: /note="Description of Artificial Sequence: Synthetic oligonucleotide"
  modified_base (8)..(9): a, c, t, g, unknown or other
  modified_base (15)..(15): a, c, t, g, unknown or other
rtrsgggnnaattan

SEQ ID NO: 1259 - DNA, 17 bp, Artificial Sequence
  source: /note="Description of Artificial Sequence: Synthetic oligonucleotide"
  modified_base (8)..(10): a, c, t, g, unknown or other
rtrsgggnnnattgtky

SEQ ID NO: 1260 - DNA, 15 bp, Artificial Sequence
  source: /note="Description of Artificial Sequence: Synthetic oligonucleotide"
  modified_base (8)..(9): a, c, t, g, unknown or other
rtrsgggnntaatkr

SEQ ID NO: 1261 - DNA, 23 bp, Artificial Sequence
  source: /note="Description of Artificial Sequence: Synthetic oligonucleotide"
  modified_base (12)..(16): a, c, t, g, unknown or other
  modified_base (21)..(23): a, c, t, g, unknown or other
rtrskggcggannnnnatccnnn

SEQ ID NO: 1262 - DNA, 24 bp, Artificial Sequence
  source: /note="Description of Artificial Sequence: Synthetic oligonucleotide"
  modified_base (12)..(17): a, c, t, g, unknown or other
  modified_base (22)..(24): a, c, t, g, unknown or other
rtrskggcggannnnnnatccnnn

SEQ ID NO: 1263 - DNA, 16 bp, Artificial Sequence
  source: /note="Description of Artificial Sequence: Synthetic oligonucleotide"
  modified_base (9)..(9): a, c, t, g, unknown or other
  modified_base (16)..(16): a, c, t, g, unknown or other
symrtaaanatygatn

SEQ ID NO: 1264 - DNA, 19 bp, Artificial Sequence
  source: /note="Description of Artificial Sequence: Synthetic oligonucleotide"
  modified_base (9)..(12): a, c, t, g, unknown or other
  modified_base (19)..(19): a, c, t, g, unknown or other
symrtaaannnncasstgn

SEQ ID NO: 1265 - DNA, 14 bp, Artificial Sequence
  source: /note="Description of Artificial Sequence: Synthetic oligonucleotide"
  modified_base (14)..(14): a, c, t, g, unknown or other
wgttkmcggawrtn

SEQ ID NO: 1266 - DNA, 20 bp, Artificial Sequence
  source: /note="Description of Artificial Sequence: Synthetic oligonucleotide"
  modified_base (2)..(2): a, c, t, g, unknown or other
  modified_base (18)..(18): a, c, t, g, unknown or other
ynattagtcacgcwtsrntr

SEQ ID NO: 1267 - DNA, 22 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
ncasstgnnnnnnnnrtrcggg

SEQ ID NO: 1268 - DNA, 22 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(19): a, c, t, g, unknown or other
nggtgtgnnnggcgcsnnncrc

SEQ ID NO: 1269 - DNA, 15 bp, Artificial Sequence
  source: /note="Description of Artificial Sequence: Synthetic oligonucleotide"
  modified_base (1)..(2): a, c, t, g, unknown or other
  modified_base (7)..(7): a, c, t, g, unknown or other
  modified_base (9)..(11): a, c, t, g, unknown or other
nncggangnnntwaa

SEQ ID NO: 1270 - DNA, 15 bp, Artificial Sequence
  source: /note="Description of Artificial Sequence: Synthetic oligonucleotide"
  modified_base (1)..(2): a, c, t, g, unknown or other
  modified_base (10)..(10): a, c, t, g, unknown or other
nncggawgtnrtwaa

SEQ ID NO: 1271 - DNA, 13 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ntatkcagygtna

SEQ ID NO: 1272 - DNA, 13 bp, Artificial Sequence
  source: /note="Description of Artificial Sequence: Synthetic oligonucleotide"
  modified_base (1)..(1): a, c, t, g, unknown or other
  modified_base (12)..(12): a, c, t, g, unknown or other
ntatkcagygtna

SEQ ID NO: 1273 - DNA, 23 bp, Artificial Sequence
  source: /note="Description of Artificial Sequence: Synthetic oligonucleotide"
  modified_base (8)..(17): a, c, t, g, unknown or other
ratcratnnnnnnnnnnrgyaac

SEQ ID NO: 1274 - DNA, 22 bp, Artificial Sequence
  source: /note="Description of Artificial Sequence: Synthetic oligonucleotide"
  modified_base (8)..(16): a, c, t, g, unknown or other
ratcratnnnnnnnnnrgyaac

SEQ ID NO: 1275 - DNA, 28 bp, Artificial Sequence
  source: /note="Description of Artificial Sequence: Synthetic oligonucleotide"
  modified_base (8)..(21): a, c, t, g, unknown or other
rcatwccnnnnnnnnnnnnnnrtmaaca

SEQ ID NO: 1276 - DNA, 27 bp, Artificial Sequence
  source: /note="Description of Artificial Sequence: Synthetic oligonucleotide"
  modified_base (8)..(20): a, c, t, g, unknown or other
rcatwccnnnnnnnnnnnnnrtmaaca

SEQ ID NO: 1277 - DNA, 26 bp, Artificial Sequence
  source: /note="Description of Artificial Sequence: Synthetic oligonucleotide"
  modified_base (8)..(19): a, c, t, g, unknown or other
rcatwccnnnnnnnnnnnnrtmaaca

SEQ ID NO: 1278 - DNA, 25 bp, Artificial Sequence
  source: /note="Description of Artificial Sequence: Synthetic oligonucleotide"
  modified_base (8)..(18): a, c, t, g, unknown or other
rcatwccnnnnnnnnnnnrtmaaca

SEQ ID NO: 1279 - DNA, 22 bp, Artificial Sequence
  source: /note="Description of Artificial Sequence: Synthetic oligonucleotide"
  modified_base (8)..(11): a, c, t, g, unknown or other
  modified_base (18)..(18): a, c, t, g, unknown or other
rcatwcynnnntaatyrnatta

SEQ ID NO: 1280 - DNA, 20 bp, Artificial Sequence
  source: /note="Description of Artificial Sequence: Synthetic oligonucleotide"
  modified_base (18)..(18): a, c, t, g, unknown or other
rscggaacyacgcwysantg

SEQ ID NO: 1281 - DNA, 20 bp, Artificial Sequence
  source: /note="Description of Artificial Sequence: Synthetic oligonucleotide"
  modified_base (18)..(18): a, c, t, g, unknown or other
rscggaacyacgcwysantg

SEQ ID NO: 1282 - DNA, 20 bp, Artificial Sequence
  source: /note="Description of Artificial Sequence: Synthetic oligonucleotide"
  modified_base (18)..(18): a, c, t, g, unknown or other
rscggaacyacgcwysantg

SEQ ID NO: 1283 - DNA, 17 bp, Artificial Sequence
  source: /note="Description of Artificial Sequence: Synthetic oligonucleotide"
  modified_base (8)..(9): a, c, t, g, unknown or other
  modified_base (16)..(16): a, c, t, g, unknown or other
rscggaannaggygyna

SEQ ID NO: 1284 - DNA, 16 bp, Artificial Sequence
  source: /note="Description of Artificial Sequence: Synthetic oligonucleotide"
  modified_base (8)..(9): a, c, t, g, unknown or other
rscggaannrtmaaya

SEQ ID NO: 1285 - DNA, 15 bp, Artificial Sequence
  source: /note="Description of Artificial Sequence: Synthetic oligonucleotide"
  modified_base (8)..(8): a, c, t, g, unknown or other
rscggaanrtmaaya

SEQ ID NO: 1286 - DNA, 15 bp, Artificial Sequence
  source: /note="Description of Artificial Sequence: Synthetic oligonucleotide"
  modified_base (8)..(9): a, c, t, g, unknown or other
rtrcgggnncasstg

SEQ ID NO: 1287 - DNA, 14 bp, Artificial Sequence
  source: /note="Description of Artificial Sequence: Synthetic oligonucleotide"
rwmaacaycrtwaa

SEQ ID NO: 1288 - DNA, 18 bp, Artificial Sequence
  source: /note="Description of Artificial Sequence: Synthetic oligonucleotide"
  modified_base (4)..(7): a, c, t, g, unknown or other
  modified_base (13)..(13): a, c, t, g, unknown or other
sccnnnnggcatngtwaa

SEQ ID NO: 1289 - DNA, 27 bp, Artificial Sequence
  source: /note="Description of Artificial Sequence: Synthetic oligonucleotide"
  modified_base (1)..(1): a, c, t, g, unknown or other
  modified_base (8)..(16): a, c, t, g, unknown or other
  modified_base (21)..(22): a, c, t, g, unknown or other
  modified_base (26)..(27): a, c, t, g, unknown or other
natygatnnnnnnnnngcctnnggsnn

SEQ ID NO: 1290 - DNA, 20 bp, Artificial Sequence
  source: /note="Description of Artificial Sequence: Synthetic oligonucleotide"
  modified_base (1)..(1): a, c, t, g, unknown or other
  modified_base (8)..(14): a, c, t, g, unknown or other
ncasstgnnnnnnncsgttr

SEQ ID NO: 1291 - DNA, 21 bp, Artificial Sequence
  source: /note="Description of Artificial Sequence: Synthetic oligonucleotide"
  modified_base (1)..(1): a, c, t, g, unknown or other
  modified_base (8)..(15): a, c, t, g, unknown or other
ncasstgnnnnnnnncsgttr

SEQ ID NO: 1292 - DNA, 22 bp, Artificial Sequence
  source: /note="Description of Artificial Sequence: Synthetic oligonucleotide"
  modified_base (1)..(1): a, c, t, g, unknown or other
  modified_base (8)..(16): a, c, t, g, unknown or other
ncasstgnnnnnnnnncsgttr

SEQ ID NO: 1293 - DNA, 21 bp, Artificial Sequence
  source: /note="Description of Artificial Sequence: Synthetic oligonucleotide"
  modified_base (1)..(1): a, c, t, g, unknown or other
  modified_base (8)..(13): a, c, t, g, unknown or other
  modified_base (21)..(21): a, c, t, g, unknown or other
ncasstgnnnnnnyaacsgyn

SEQ ID NO: 1294 - DNA, 20 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (20)..(20): a, c, t, g, unknown or other
ncasstgnnnnnyaacsgyn

SEQ ID NO: 1295 - DNA, 23 bp, Artificial Sequence
  source: /note="Description of Artificial Sequence: Synthetic oligonucleotide"
  modified_base (1)..(1): a, c, t, g, unknown or other
  modified_base (9)..(9): a, c, t, g, unknown or other
  modified_base (13)..(16): a, c, t, g, unknown or other
  modified_base (23)..(23): a, c, t, g, unknown or other
nccataywnggwnnnnatcratn

SEQ ID NO: 1296 - DNA, 22 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (22)..(22): a, c, t, g, unknown or other
nggtgtgnnnnntmattwgcrn

SEQ ID NO: 1297 - DNA, 18 bp, Artificial Sequence
  source: /note="Description of Artificial Sequence: Synthetic oligonucleotide"
  modified_base (1)..(1): a, c, t, g, unknown or other
  modified_base (8)..(10): a, c, t, g, unknown or other
  modified_base (17)..(18): a, c, t, g, unknown or other
nrgcaacnnncrcgygnn

SEQ ID NO: 1298 - DNA, 23 bp, Artificial Sequence
  source: /note="Description of Artificial Sequence: Synthetic oligonucleotide"
  modified_base (1)..(1): a, c, t, g, unknown or other
  modified_base (8)..(12): a, c, t, g, unknown or other
  modified_base (19)..(20): a, c, t, g, unknown or other
  modified_base (23)..(23): a, c, t, g, unknown or other
nrgyaacnnnnncctwwwnnggn

SEQ ID NO: 1299 - DNA, 17 bp, Artificial Sequence
  source: /note="Description of Artificial Sequence: Synthetic oligonucleotide"
  modified_base (1)..(1): a, c, t, g, unknown or other
  modified_base (7)..(8): a, c, t, g, unknown or other
  modified_base (17)..(17): a, c, t, g, unknown or other
nscggannttrcgyaan

SEQ ID NO: 1300 - DNA, 22 bp, Artificial Sequence
  source: /note="Description of Artificial Sequence: Synthetic oligonucleotide"
  modified_base (1)..(1): a, c, t, g, unknown or other
  modified_base (10)..(15): a, c, t, g, unknown or other
nttrcgyaannnnnnggaatgy

SEQ ID NO: 1301 - DNA, 17 bp, Artificial Sequence
  source: /note="Description of Artificial Sequence: Synthetic oligonucleotide"
  modified_base (8)..(9): a, c, t, g, unknown or other
  modified_base (17)..(17): a, c, t, g, unknown or other
rcattccnncrcgygyn

SEQ ID NO: 1302 - DNA, 20 bp, Artificial Sequence
  source: /note="Description of Artificial Sequence: Synthetic oligonucleotide"
  modified_base (8)..(12): a, c, t, g, unknown or other
  modified_base (20)..(20): a, c, t, g, unknown or other
rcattccnnnnncrcgygyn

SEQ ID NO: 1303 - DNA, 29 bp, Artificial Sequence
  source: /note="Description of Artificial Sequence: Synthetic oligonucleotide"
  modified_base (6)..(6): a, c, t, g, unknown or other
  modified_base (9)..(16): a, c, t, g, unknown or other
  modified_base (18)..(19): a, c, t, g, unknown or other
rggtgngannnnnnnntnncaccggaagy

SEQ ID NO: 1304 - DNA, 24 bp, Artificial Sequence
  source: /note="Description of Artificial Sequence: Synthetic oligonucleotide"
  modified_base (7)..(9): a, c, t, g, unknown or other
  modified_base (15)..(16): a, c, t, g, unknown or other
  modified_base (18)..(19): a, c, t, g, unknown or other
  modified_base (23)..(24): a, c, t, g, unknown or other
rggtgtnnnggcgsnntnncrsnn

SEQ ID NO: 1305 - DNA, 28 bp, Artificial Sequence
  source: /note="Description of Artificial Sequence: Synthetic oligonucleotide"
  modified_base (8)..(18): a, c, t, g, unknown or other
  modified_base (20)..(20): a, c, t, g, unknown or other
  modified_base (28)..(28): a, c, t, g, unknown or other
rgtgtkrnnnnnnnnnnncncmggaarn

SEQ ID NO: 1306 - DNA, 23 bp, Artificial Sequence
  source: /note="Description of Artificial Sequence: Synthetic oligonucleotide"
  modified_base (13)..(16): a, c, t, g, unknown or other
  modified_base (21)..(23): a, c, t, g, unknown or other
rgwatscggatgnnnntccknnn

SEQ ID NO: 1307 - DNA, 20 bp, Artificial Sequence
  source: /note="Description of Artificial Sequence: Synthetic oligonucleotide"
  modified_base (10)..(13): a, c, t, g, unknown or other
  modified_base (20)..(20): a, c, t, g, unknown or other
rrcrcgygynnnnsgcgcsn

SEQ ID NO: 1308 - DNA, 17 bp, Artificial Sequence
  source: /note="Description of Artificial Sequence: Synthetic oligonucleotide"
  modified_base (8)..(9): a, c, t, g, unknown or other
  modified_base (17)..(17): a, c, t, g, unknown or other
rscggaannrtmaayan

SEQ ID NO: 1309 - DNA, 17 bp, Artificial Sequence
  source: /note="Description of Artificial Sequence: Synthetic oligonucleotide"
  modified_base (8)..(8): a, c, t, g, unknown or other
  modified_base (17)..(17): a, c, t, g, unknown or other
rscggawnttrcgyaan

SEQ ID NO: 1310 - DNA, 25 bp, Artificial Sequence
  source: /note="Description of Artificial Sequence: Synthetic oligonucleotide"
  modified_base (4)..(4): a, c, t, g, unknown or other
  modified_base (14)..(18): a, c, t, g, unknown or other
  modified_base (24)..(25): a, c, t, g, unknown or other
rtgnkggcggawgnnnnntccggnn

SEQ ID NO: 1311 - DNA, 24 bp, Artificial Sequence
  source: /note="Description of Artificial Sequence: Synthetic oligonucleotide"
  modified_base (4)..(4): a, c, t, g, unknown or other
  modified_base (14)..(17): a, c, t, g, unknown or other
  modified_base (23)..(24): a, c, t, g, unknown or other
rtgnkggcggawgnnnntccggnn

SEQ ID NO: 1312 - DNA, 20 bp, Artificial Sequence
  source: /note="Description of Artificial Sequence: Synthetic oligonucleotide"
  modified_base (8)..(13): a, c, t, g, unknown or other
  modified_base (20)..(20): a, c, t, g, unknown or other
rtrcgggnnnnnnatcratn

SEQ ID NO: 1313 - DNA, 20 bp, Artificial Sequence
  source: /note="Description of Artificial Sequence: Synthetic oligonucleotide"
  modified_base (4)..(4): a, c, t, g, unknown or other
  modified_base (9)..(11): a, c, t, g, unknown or other
  modified_base (19)..(20): a, c, t, g, unknown or other
rtrnkggtnnngcacgygnn

SEQ ID NO: 1314 - DNA, 26 bp, Artificial Sequence
  source: /note="Description of Artificial Sequence: Synthetic oligonucleotide"
  modified_base (4)..(6): a, c, t, g, unknown or other
  modified_base (10)..(12): a, c, t, g, unknown or other
  modified_base (18)..(20): a, c, t, g, unknown or other
  modified_base (25)..(26): a, c, t, g, unknown or other
sccnnnggsnnnggaagnnnttccnn

SEQ ID NO: 1315 - DNA, 21 bp, Artificial Sequence
  source: /note="Description of Artificial Sequence: Synthetic oligonucleotide"
  modified_base (11)..(14): a, c, t, g, unknown or other
  modified_base (21)..(21): a, c, t, g, unknown or other
srcrcgygsynnnnsgcgcsn

SEQ ID NO: 1316 - DNA, 14 bp, Artificial Sequence
  source: /note="Description of Artificial Sequence: Synthetic oligonucleotide"
  modified_base (2)..(2): a, c, t, g, unknown or other
wngtgykamatwcy

SEQ ID NO: 1317 - DNA, 22 bp, Artificial Sequence
  source: /note="Description of Artificial Sequence: Synthetic oligonucleotide"
  modified_base (8)..(13): a, c, t, g, unknown or other
  modified_base (22)..(22): a, c, t, g, unknown or other
mtrsgggnnnnnnttrcgyaan

SEQ ID NO: 1318 - DNA, 21 bp, Artificial Sequence
  source: /note="Description of Artificial Sequence: Synthetic oligonucleotide"
  modified_base (8)..(12): a, c, t, g, unknown or other
  modified_base (21)..(21): a, c, t, g, unknown or other
mtrsgggnnnnnttrcgyaan

SEQ ID NO: 1319 - DNA, 30 bp, Artificial Sequence
  source: /note="Description of Artificial Sequence: Synthetic oligonucleotide"
  modified_base (1)..(1): a, c, t, g, unknown or other
  modified_base (7)..(19): a, c, t, g, unknown or other
  modified_base (23)..(23): a, c, t, g, unknown or other
  modified_base (25)..(26): a, c, t, g, unknown or other
  modified_base (30)..(30): a, c, t, g, unknown or other
nggtgtnnnnnnnnnnnnncacntnntwan

SEQ ID NO: 1320 - DNA, 23 bp, Artificial Sequence
  source: /note="Description of Artificial Sequence: Synthetic oligonucleotide"
  modified_base (1)..(1): a, c, t, g, unknown or other
  modified_base (10)..(15): a, c, t, g, unknown or other
  modified_base (17)..(17): a, c, t, g, unknown or other
  modified_base (22)..(23): a, c, t, g, unknown or other
ngygytaaynnnnnntnacacnn

SEQ ID NO: 1321 - DNA, 24 bp, Artificial Sequence
  source: /note="Description of Artificial Sequence: Synthetic oligonucleotide"
  modified_base (1)..(2): a, c, t, g, unknown or other
  modified_base (9)..(15): a, c, t, g, unknown or other
  modified_base (19)..(21): a, c, t, g, unknown or other
nncrcgygnnnnnnnsccnnnggs

SEQ ID NO: 1322 - DNA, 23 bp, Artificial Sequence
  source: /note="Description of Artificial Sequence: Synthetic oligonucleotide"
  modified_base (1)..(2): a, c, t, g, unknown or other
  modified_base (9)..(14): a, c, t, g, unknown or other
  modified_base (18)..(20): a, c, t, g, unknown or other
nncrcgygnnnnnnsccnnnggs

SEQ ID NO: 1323 - DNA, 24 bp, Artificial Sequence
  source: /note="Description of Artificial Sequence: Synthetic oligonucleotide"
  modified_base (1)..(2): a, c, t, g, unknown or other
  modified_base (6)..(9): a, c, t, g, unknown or other
  modified_base (16)..(19): a, c, t, g, unknown or other
  modified_base (23)..(24): a, c, t, g, unknown or other
nngygnnnnggcgcsnnnncrcnn

SEQ ID NO: 1324 - DNA, 30 bp, Artificial Sequence
  source: /note="Description of Artificial Sequence: Synthetic oligonucleotide"
  modified_base (1)..(3): a, c, t, g, unknown or other
  modified_base (9)..(11): a, c, t, g, unknown or other
  modified_base (16)..(26): a, c, t, g, unknown or other
  modified_base (30)..(30): a, c, t, g, unknown or other
nnntatgcnnngygannnnnnnnnnncrcn

SEQ ID NO: 1325 - DNA, 24 bp, Artificial Sequence
  source: /note="Description of Artificial Sequence: Synthetic oligonucleotide"
  modified_base (1)..(2): a, c, t, g, unknown or other
  modified_base (6)..(6): a, c, t, g, unknown or other
  modified_base (8)..(8): a, c, t, g, unknown or other
  modified_base (12)..(17): a, c, t, g, unknown or other
  modified_base (23)..(24): a, c, t, g, unknown or other
nnsygncnaacnnnnnncacrcnn

SEQ ID NO: 1326 - DNA, 24 bp, Artificial Sequence
  source: /note="Description of Artificial Sequence: Synthetic oligonucleotide"
  modified_base (1)..(1): a, c, t, g, unknown or other
  modified_base (10)..(17): a, c, t, g, unknown or other
nttrcgyaannnnnnnnrgwatgy

SEQ ID NO: 1327 - DNA, 23 bp, Artificial Sequence
  source: /note="Description of Artificial Sequence: Synthetic oligonucleotide"
  modified_base (1)..(1): a, c, t, g, unknown or other
  modified_base (10)..(16): a, c, t, g, unknown or other
nttrcgyaannnnnnnrgwatgy

SEQ ID NO: 1328 - DNA, 22 bp, Artificial Sequence
  source: /note="Description of Artificial Sequence: Synthetic oligonucleotide"
  modified_base (1)..(1): a, c, t, g, unknown or other
  modified_base (10)..(15): a, c, t, g, unknown or other
nttrcgyaannnnnnrgwatgy

SEQ ID NO: 1329 - DNA, 28 bp, Artificial Sequence
  source: /note="Description of Artificial Sequence: Synthetic oligonucleotide"
  modified_base (8)..(16): a, c, t, g, unknown or other
  modified_base (18)..(19): a, c, t, g, unknown or other
  modified_base (24)..(24): a, c, t, g, unknown or other
  modified_base (28)..(28): a, c, t, g, unknown or other
rggtgwknnnnnnnnntnncrtrngggn

SEQ ID NO: 1330 - DNA, 18 bp, Artificial Sequence
  source: /note="Description of Artificial Sequence: Synthetic oligonucleotide"
  modified_base (8)..(9): a, c, t, g, unknown or other
  modified_base (18)..(18): a, c, t, g, unknown or other
rgwatgynnttrcgyaan

SEQ ID NO: 1331 - DNA, 22 bp, Artificial Sequence
  source: /note="Description of Artificial Sequence: Synthetic oligonucleotide"
  modified_base (1)..(1): a, c, t, g, unknown or other
  modified_base (5)..(6): a, c, t, g, unknown or other
  modified_base (14)..(15): a, c, t, g, unknown or other
  modified_base (22)..(22): a, c, t, g, unknown or other
ngygnnamatwcynntmrcrcn

SEQ ID NO: 1332 - DNA, 16 bp, Artificial Sequence
  source: /note="Description of Artificial Sequence: Synthetic oligonucleotide"
tctttacatgtaaagc

SEQ ID NO: 1333 - DNA, 16 bp, Artificial Sequence
  source: /note="Description of Artificial Sequence: Synthetic oligonucleotide"
ctagaatggtaccaag

SEQ ID NO: 1334 - DNA, 11 bp, Artificial Sequence
  source: /note="Description of Artificial Sequence: Synthetic oligonucleotide"
gttacaatgag

The invention claimed is:

1. A method for increasing OTC gene expression in a cell harboring an OTC mutation associated with a partial reduction of OTC function, comprising: contacting the cell with an effective amount of a compound that increases CPS1 expression, wherein the compound inhibits HSP90.

2. The method of claim 1, wherein the cell is a hepatocyte.

3. The method of claim 1, wherein the compound is selected from the group consisting of EC144, 17-AAG, BIIB021, HSP-990, retaspimycin hydrochloride (HCl), PF-0492911, luminespib, alvespimycin, and alvespimycin hydrochloride (HCl).

4. The method of claim 3, wherein the compound is EC144.

5. The method of claim 1, wherein the compound is an siRNA.

6. A method for increasing OTC expression in a subject harboring an OTC mutation associated with a partial reduction of OTC function, comprising: administering to the subject an effective amount of a compound that increases CPS1 expression, wherein the compound inhibits HSP90.

7. The method of claim 6, wherein the subject is human.

8. The method of claim 6, wherein the compound is selected from the group consisting of EC144, 17-AAG, BIIB021, HSP-990, retaspimycin hydrochloride (HCl), PF-0492911, luminespib, alvespimycin, and alvespimycin hydrochloride (HCl).

9. The method of claim 8, wherein the compound is EC144.

10. The method of claim 6, wherein the compound is an siRNA.

* * * * *

UNITED STATES PATENT AND TRADEMARK OFFICE
CERTIFICATE OF CORRECTION

PATENT NO. : 11,266,655 B2
APPLICATION NO. : 17/121639
DATED : March 8, 2022
INVENTOR(S) : Alfica Sehgal et al.

It is certified that error appears in the above-identified patent and that said Letters Patent is hereby corrected as shown below:

On the Title Page

In Column 2, item (57), under Abstract, Line 1, replace "for the treating" with --for treating--.

Signed and Sealed this
Twenty-eighth Day of February, 2023

Katherine Kelly Vidal
*Director of the United States Patent and Trademark Office*